(12) United States Patent
Li et al.

(10) Patent No.: US 9,574,002 B2
(45) Date of Patent: Feb. 21, 2017

(54) HUMAN ANTIGEN BINDING PROTEINS THAT BIND TO A COMPLEX COMPRISING β-KLOTHO AND AN FGF RECEPTOR

(75) Inventors: Yang Li, Mountain View, CA (US); Jennitte Stevens, Ventura, CA (US); Chadwick Terence King, North Vancouver (CA); Ian Foltz, Burnaby (CA); Gunasekaran Kannan, Newbury Park, CA (US); Junming Yie, Thousand Oaks, CA (US); Shaw-Fen Sylvia Hu, Thousand Oaks, CA (US)

(73) Assignee: AMGEN INC., Thousand Oaks, CA (US)

( * ) Notice: Subject to any disclaimer, the term of this patent is extended or adjusted under 35 U.S.C. 154(b) by 50 days.

(21) Appl. No.: 13/487,061

(22) Filed: Jun. 1, 2012

(65) Prior Publication Data

US 2012/0328616 A1 Dec. 27, 2012

Related U.S. Application Data

(60) Provisional application No. 61/537,998, filed on Sep. 22, 2011, provisional application No. 61/501,133, filed on Jun. 24, 2011, provisional application No. 61/493,933, filed on Jun. 6, 2011.

(51) Int. Cl.
| | |
|---|---|
| *A61K 39/395* | (2006.01) |
| *C12N 15/13* | (2006.01) |
| *C12N 15/85* | (2006.01) |
| *C12N 5/10* | (2006.01) |
| *C07K 16/28* | (2006.01) |
| *C12P 21/02* | (2006.01) |
| *A61P 3/06* | (2006.01) |
| *A61P 3/10* | (2006.01) |
| *A61P 3/04* | (2006.01) |
| *A61P 9/00* | (2006.01) |
| *A61P 3/00* | (2006.01) |
| *C07K 14/71* | (2006.01) |
| *A61K 39/00* | (2006.01) |

(52) U.S. Cl.
CPC .......... *C07K 16/2863* (2013.01); *C07K 14/71* (2013.01); *C12Y 302/01031* (2013.01); *A61K 2039/505* (2013.01); *C07K 2317/21* (2013.01); *C07K 2317/56* (2013.01); *C07K 2317/565* (2013.01); *C07K 2317/75* (2013.01); *C07K 2319/00* (2013.01); *C07K 2319/30* (2013.01)

(58) Field of Classification Search
None
See application file for complete search history.

(56) References Cited

U.S. PATENT DOCUMENTS

| | | |
|---|---|---|
| 3,773,919 A | 11/1973 | Boswell et al. |
| 4,399,216 A | 8/1983 | Axel et al. |
| 4,740,461 A | 4/1988 | Kaufman |
| 4,751,180 A | 6/1988 | Cousens et al. |
| 4,816,567 A | 3/1989 | Cabilly et al. |
| 4,912,040 A | 3/1990 | Kaufman et al. |
| 4,935,233 A | 6/1990 | Bell et al. |
| 4,946,778 A | 8/1990 | Ladner et al. |
| 4,959,455 A | 9/1990 | Clark et al. |
| 4,965,195 A | 10/1990 | Namen et al. |
| 4,968,607 A | 11/1990 | Dower et al. |
| 5,011,912 A | 4/1991 | Hopp et al. |
| 5,262,522 A | 11/1993 | Gearing |
| 5,292,658 A | 3/1994 | Cormier et al. |
| 5,418,155 A | 5/1995 | Cormier et al. |
| 5,426,048 A | 6/1995 | Gearing |
| 5,457,035 A | 10/1995 | Baum et al. |
| 5,530,101 A | 6/1996 | Queen et al. |
| 5,545,806 A | 8/1996 | Lonberg et al. |
| 5,545,807 A | 8/1996 | Surani et al. |
| 5,585,089 A | 12/1996 | Queen et al. |
| 5,683,888 A | 11/1997 | Campbell |
| 5,693,761 A | 12/1997 | Queen et al. |
| 5,693,762 A | 12/1997 | Queen et al. |
| 5,741,668 A | 4/1998 | Ward et al. |
| 5,777,079 A | 7/1998 | Tsien et al. |
| 5,804,387 A | 9/1998 | Cormack et al. |
| 5,874,299 A | 2/1999 | Lonberg et al. |
| 5,874,304 A | 2/1999 | Zolotukhin et al. |
| 5,876,995 A | 3/1999 | Bryan |
| 5,877,293 A | 3/1999 | Adair et al. |
| 5,877,397 A | 3/1999 | Lonberg et al. |
| 5,886,152 A | 3/1999 | Nakatani et al. |
| 5,925,558 A | 7/1999 | Tsien et al. |
| 5,939,598 A | 8/1999 | Kucherlapati et al. |
| 6,054,297 A | 4/2000 | Carter et al. |
| 6,075,181 A | 6/2000 | Kucherlapati et al. |
| 6,114,598 A | 9/2000 | Kucherlapati et al. |
| 6,150,584 A | 11/2000 | Kucherlapati et al. |

(Continued)

FOREIGN PATENT DOCUMENTS

| | | |
|---|---|---|
| EP | 133988 A2 | 3/1985 |
| EP | 088046 B1 | 12/1987 |
| EP | 143949 B1 | 10/1988 |
| EP | 036676 B2 | 9/1990 |
| EP | 460846 B1 | 6/1996 |

(Continued)

OTHER PUBLICATIONS

Adams et al., (1985) Nature, 318:533-538.
Alexander et al., (1987) Mol Cell. Biol., 7:1436-1444.
Aplin & Wriston (1981) CRC Crit. Reviews in Biochemistry. 10:259-306.
Ashikenazi et al., (1991) Proc. Natl. Acad. Sci USA 88:10535.

(Continued)

*Primary Examiner* — David Romeo

(57) ABSTRACT

The present invention provides compositions and methods relating to or derived from antigen binding proteins capable of inducing B-Klotho, and or FGF21-like mediated signaling.

14 Claims, 13 Drawing Sheets

(56) References Cited

U.S. PATENT DOCUMENTS

| | | | |
|---|---|---|---|
| 6,162,963 | A | 12/2000 | Kucherlapati et al. |
| 6,180,370 | B1 | 1/2001 | Queen et al. |
| 6,255,458 | B1 | 7/2001 | Lonberg et al. |
| 6,270,964 | B1 | 8/2001 | Michnick et al. |
| 6,300,129 | B1 | 10/2001 | Lonberg et al. |
| 6,673,986 | B1 | 1/2004 | Kucherlapati et al. |
| 6,696,245 | B2 | 2/2004 | Winter et al. |
| 6,713,610 | B1 | 3/2004 | Kucherlapati et al. |
| 7,919,297 | B2 | 4/2011 | Lei |
| 8,759,620 | B2 | 6/2014 | Chen et al. |
| 2003/0039958 | A1 | 2/2003 | Holt et al. |
| 2004/0009507 | A1 | 1/2004 | Winter et al. |
| 2004/0038291 | A2 | 2/2004 | Tomlinson et al. |
| 2004/0202995 | A1 | 10/2004 | de Wildt et al. |
| 2005/0202512 | A1 | 9/2005 | Tomlinson et al. |
| 2008/0261236 | A1* | 10/2008 | Kuro-o ............ G01N 33/573 435/7.1 |

FOREIGN PATENT DOCUMENTS

| | | |
|---|---|---|
| EP | 463151 B1 | 6/1996 |
| EP | 367566 B1 | 5/1997 |
| EP | 058481 B2 | 5/2003 |
| JP | 3068180 B2 | 5/2000 |
| JP | 3068506 B2 | 7/2000 |
| JP | 3068507 B2 | 7/2000 |
| WO | 87/05330 A1 | 9/1987 |
| WO | 90/04036 A1 | 4/1990 |
| WO | 91/10741 A1 | 7/1991 |
| WO | 92/15673 A1 | 9/1992 |
| WO | 93/00829 A1 | 1/1993 |
| WO | 93/10151 A1 | 5/1993 |
| WO | 94/02602 A1 | 2/1994 |
| WO | 94/10308 A1 | 5/1994 |
| WO | 94/20069 A1 | 9/1994 |
| WO | 95/07463 A1 | 3/1995 |
| WO | 96/33735 A1 | 10/1996 |
| WO | 96/34096 A2 | 10/1996 |
| WO | 97/23091 A1 | 6/1997 |
| WO | 98/14605 A1 | 4/1998 |
| WO | 98/24893 A2 | 6/1998 |
| WO | 98/26277 A1 | 6/1998 |
| WO | 99/10494 A2 | 3/1999 |
| WO | 99/49019 A2 | 9/1999 |
| WO | 00/09560 A2 | 2/2000 |
| WO | 00/76310 A1 | 12/2000 |
| WO | 2005/066211 A2 | 7/2005 |
| WO | 2010/139741 A1 | 12/2010 |
| WO | 2011/071783 A1 | 6/2011 |
| WO | 2011/130417 A2 | 10/2011 |
| WO | 2012/059873 A2 | 5/2012 |
| WO | 2012/158704 A1 | 11/2012 |

OTHER PUBLICATIONS

Baum et al. (1994) EMBO J. 13:3992-4001.
Benoist & Chambon (1981) Nature 290:340-310.
Bianchi and McGrew (2003) Biotech. Biotechnol. Bioeng. 84:439-444.
Bird et al., (1988) Science 242:423-26.
Bloom et al., (1997) Protein Science 6:407-15.
Bowie et al., (1991) Science 253:164-170.
Brams et al. (1998) J Immunol 160:2051-2058.
Brenner et al. (1997) Curr. Op. Struct Biol 7:369-376.
Brinster et al (1982) Nature 296:39-42.
Bruggermann et al., (1993) Year in Immunol. 7:33.
Bryn et al (1990) Nature 344:677.
Carballido et al., (2000) Nat. Med., 6:103-106.
Carrillo et al., (1988) J. Applied Math. 48: 073.
Chalfie et al., (1994) Science 263:802-805.
Cheung, et al., (1990) Virology 176:546-552.
Chothia et al., (1987) J. Mol. Biol 196:901-917.
Chothia et al., (1989) Nature 342: 878-883.
Chou et al., (1974) Biochemistry 113:211-222.
Chou et al., (1979) Ann. Rev. Biochem. 47:251-276.
Chou et al., (1979) Biophys. J. 26:367-384.
Chu et al., (1981) Gene 13:197.
Cosman et al., (1984) Nature 312:768-771.
Dayhoff et al., (1978) Atlas of Protein Sequence and Structure 5:345-352.
DeBoer et al (1983) Proc. Natl. Acad. Sci. US 80:21-25.
DeGraaf et al (2002) Methods Mol Biol 178:379-387.
Devereux et al., (1984) Nucl. Acid Res. 1073:387-395.
Ding et al., (2012) Cell Metabolism 15:3 387-393.
Duskin et al., (1982) J. Biol. Chem. 257:3105-3109.
Edge et al. (1981) Anal. Biochem 118:131-137.
Eppstein et al., (1985) Proc. Natl. Acad. Sci. US, 82:3688-3692.
Evans et al., (1987) J. Med. Chem. 30:1229.
Fanslow et al. (1994) Semin Immunol 6:267-278.
Fauchere, (1986) Adv. Drug Res. 15:29.
Foltz, et al., 2012, Basic Research Cardiology 107:290 1-18.
GenBank Accession No. J01749, New England Biolabs, Beverly, MA, (1983).
GenBank Accession No. NP_034336, (1992).
GenBank Accession No. P11362; (1991).
GenBank Accession No. NP_112457, (1998).
GenBank Accession No. NP_783864, (2005).
Graham et al., (1973) Virology 52:456.
Gribskov et al (1987) Proc. Nat. Acad. Sci. 84:4355-4358.
Gribskov et al (1990) Meth. Enzym. 183: 46-159.
Grosschedl et al., (1984) Cell, 38:647-688.
Gupte et al., (2011) J. Mol. Biol 408:491-502.
Hakimuddin et al. (1987) Arch. Biochem. Biophys. 259:52-57.
Hammer et al., (1987) Science, 253:53-58.
Hanahan, (1985) Nature 315:115-122.
Heim et al (1996) Curr. Biol 6:178-182.
Henikoff et al., (1992) Proc. Natl. Acad. Sci. U.S.A. 89:10915-10919.
Hollenbaugh et al (1992) Current Protocols in Immunology, Suppl 4, 10.19.1-10.19.11.
Holliger et al., (1993) Proc. Natl. Acad. Sci. US 90:6444-6448.
Holm et al., (1999) Nucl. Acid. Res 27:244-247.
Honegger & Pluckthun (2001) J. Mol Biol., 309: 657-670.
Hoogenboom et al., (1991) J. Mol. Biol. 227:381.
Hopp et al., (1988) Bio/Technology 6:1204.
Hoppe et al., (1994) FEBS Letters 344:191.
Huston et al., (1988) Proc. Natl. Acad. Sci. US 85:5879-5883).
Ichiki et al.,(1993) J. Immunol 150:5408-5417.
Ifversen et al., (1996) Immunology 8:243-248.
Itoh et al., (2004) Trend Genet. 20:563-69).
Jakobovits et al., (1993) Proc. Natl. Acad. Sci USA 90:2551-2555.
Jakobvits et al. (1993) Nature 362: 255-258.
Jalkanen et al., (1985) J. Cell. Biol 101:976-985.
Jalkanen et al., (1987) J. Cell. Biol 105:3087-3096.
Jing et al. (2009) American Diabetes Association, US 58:1 250-259.
Jones (1997) Curr. Opin. Struct. Biol 7:377-387.
Jones et al., (1986) Nature, 321:522-525.
Kaess et al, (2010) EP J of Human Genetics 18:12, 1344-1348.
Kearney et al., (1979) J. Immunol. 123:4, 1548-1550.
Kelsey et al., (1987) Genes and Devel., 1:161-171.
Kharitonenkov et al., (2008) BioDrugs 22:37-44).
Kharitonenkov et al., (2008) J. Cell Physiol. 215:1-7.
Kirkland et al., (1986) J. Immunol. 137:3614-3619.
Kohler et al., (1975) Nature 256:495-497.
Kollias et al., (1986) Cell, 45:89-94.
Korndorfer et al., (2003) Proteins: Structure, Function, and Bioinformatics, 53:1, 121-129.
Kortt et al., (1997) Protein Eng. 10:4, 423-433.
Kortt et al., (2001) Biomol. Eng. 18:95-108.
Kostelny et al., (1992) J. Immunol, 148: 1547-1553.
Kriangku, et al (2001) Biomol Eng. 18: 31-40.
Krumlauf et al., Mol Cell. Biol., 1985, 5:1639-1648.
Kurosu et al., (2007) J. Biol. Chem. 282:26687-26695).
Kyte et al., (1982) J. Mol. Biol. 157:105-131.
Landschultz et al., (1988) Science 240:1759-1765.

(56) References Cited

OTHER PUBLICATIONS

Langer et al., (1981) J. Biomed. Mater. Res. 15:167-277.
Langer et al., (1982) Chem. Tech. 12:98-105.
Lantto et al (2002) Methods Mol. Biol 178: 303-316.
Leder et al., (1986) Cell, 45:485-495.
MacDonald, (1987) Hepatology, 7:425-515.
Magram et al., (1985), Nature, 315:338-340.
Marks et al (1992) Biotechnology 10:779-783.
Marks et al., (1991) J. Mol. Biol. 222:581.
Martensson et al., (1994).Immunol., 83:1271-1279.
Martensson et al., (1995) Immunol., 84:224-230.
Masashi et al., (2008) Molecular Endocrin, US 22:4 1006-1014.
Mason et al., (1986), Science, 234:1372-1378.
McCune et al., (1988); Science, 241:1532-1639.
Mendez et al (1997) Nature Genetics, 15: 146-156.
Mohammadi et al., (2005) Cytokine Growth Factor Reviews, 15:107-137.
Moldenhauer et al. (1990) Scand. J. Immunol, 32: 77-82.
Morel et al., (1988) Molec. Immunol. 25:7-15.
Morrison et al., (1984) Proc. Natl. Acad. Sci. USA 81:6851-6855.
Mosier et al., (1988); Nature, 335:256-259.
Moult, (1996) Curr. Op. In Biotech. 7:422-427.
Murphy et al., (1995); Blood, 86:1946-1953.
Nanevicz et al., (1995) J. Biol. Chem., 270:37, 21619-21625.
Needleman et al., (1970); J. Mol. Biol. 48:443-453.
Nolan et al (1988); Proc. Natl Acad. Sci USA 85:2603-2607.
Ogawa et al., (2007;) Proc. Natl. Acad Sci USA 104:7432-37.
Ornitz et al. (1986); Cold Spring Harbor Symp. Quant. Biol.; 50:399-409.
Pinkert et al., (1987); Genes and Develop, 1:268-276.
Poljak et al., (1994) Structure 2:1121-23.
Readhead et al., (1987); Cell, 48:703-712.
Reichmann et al., (1988) Nature 332:323-327.
Rizo et al. (1992) Ann. Rev. Biochem 61:387.
Roque et al., (2004); Biotechnol. Prog 20:639-654.
Shani, (1985); Nature, 314:283-286.
Sidman et al., (1983) Biopolymers 2:547-556.
Sipp et al., (1996) Structure 4:15-19.
Sleving et al. (2006) Proc Natl Acad Sciences US, 103:10, 3896-3901.
Songsivilai & Lachmann, (1990) Clin. Exp. Immunol., 79:316-321.
Stahli et al., (1983) Methods in Enzymology 9:242-253.
Stauber (1998) Biotechniques 24:462-471.
Swift et al., (1984); Cell, 38:639-646.
Tao et al., (2002) Invest. Ophthalmol Visual Science, 43:3292-3298.
Thornsen et al., (1984) Proc. Natl. Acad. USA 81: 659-663.
Thornton et al., (1991) Nature, 354:105.
Thotakura et al (1987) Meth Enzymol 138:350-359.
Veber and Freidinger, (1985) TINS p. 392.
Verhoeyen et al., (1988) Science 239: 1534-1536.
Vila-Kamaroff et al (1978) Proc. Natl. Acad. Sci USA, 75:3727-3731.
Wagner et al. (1981) Proc. Natl. Acad. Sci USA, 78: 1444-1445.
Ward et al.,(1989); Nature, 341:544-546.
Wu et al., (2011) Science Translational Medicine, 3:1113 112-114.
Wu et al., (2009) Aging, 1:12 1023-1027.
Yamamoto et al (1980) Cell 22: 787-797.
Zupnick et al., (2006) J. Biol. Chem., 281:29, 20464-20473.

* cited by examiner

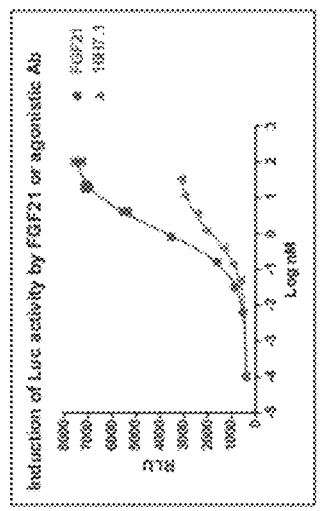
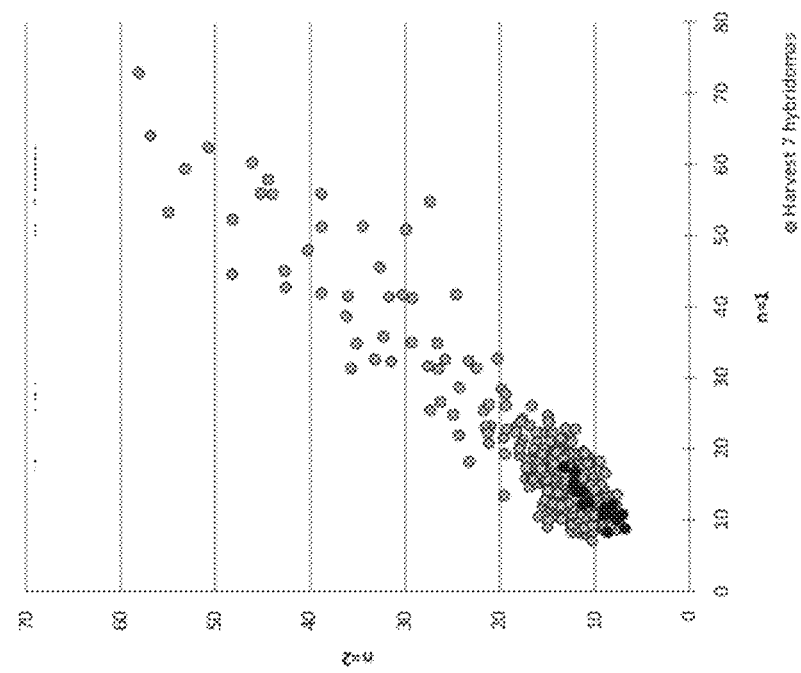
Figure 3

Overlapping patches of mouse in human bKlotho

HUMAN ANTIGEN BINDING PROTEINS THAT BIND TO A COMPLEX COMPRISING β-KLOTHO AND AN FGF RECEPTOR

This application claims benefit to U.S. Provisional applications 61/493,933 (filed Jun. 6, 2011), 61/501,133 (filed Jun. 24, 2011), and 61/537,998 (filed Sep. 22, 2011), the contents of each of which are hereby incorporated in their entirety.

SEQUENCE LISTING

The instant application contains a Sequence Listing which has been submitted in ASCII format via EFS-Web and is hereby incorporated by reference in its entirety. Said ASCII copy, created on Aug. 10, 2016, is named A-1650-US-NP_SEQ_LIST_2094_081016ST25.txt and is 1,661 KB in size.

FIELD OF THE INVENTION

The present disclosure relates to nucleic acid molecules encoding antigen binding proteins that bind to a complex comprising β-Klotho and at least one of (i) FGFR1c, (ii) FGFR2c and (iii) FGFR3c, including antigen binding proteins that induce FGF21-like signaling, as well as pharmaceutical compositions comprising antigen binding proteins that bind to a complex comprising β-Klotho and at least one of (i) FGFR1c, (ii) FGFR2c and (iii) FGFR3c, including antigen binding proteins that induce FGF21-like signaling, and methods for treating metabolic disorders using such nucleic acids, polypeptides, or pharmaceutical compositions. Diagnostic methods using the antigen binding proteins are also provided.

BACKGROUND

Fibroblast Growth Factor 21 (FGF21) is a secreted polypeptide that belongs to a subfamily of Fibroblast Growth Factors (FGFs) that includes FGF19, FGF21, and FGF23 (Itoh et al., (2004) *Trend Genet.* 20:563-69). FGF21 is an atypical FGF in that it is heparin independent and functions as a hormone in the regulation of glucose, lipid, and energy metabolism.

It is highly expressed in liver and pancreas and is the only member of the FGF family to be primarily expressed in liver. Transgenic mice overexpressing FGF21 exhibit metabolic phenotypes of slow growth rate, low plasma glucose and triglyceride levels, and an absence of age-associated type 2 diabetes, islet hyperplasia, and obesity. Pharmacological administration of recombinant FGF21 protein in rodent and primate models results in normalized levels of plasma glucose, reduced triglyceride and cholesterol levels, and improved glucose tolerance and insulin sensitivity. In addition, FGF21 reduces body weight and body fat by increasing energy expenditure, physical activity, and metabolic rate. Experimental research provides support for the pharmacological administration of FGF21 for the treatment of type 2 diabetes, obesity, dyslipidemia, and other metabolic conditions or disorders in humans.

FGF21 is a liver derived endocrine hormone that stimulates glucose uptake in adipocytes and lipid homeostasis through the activation of its receptor. Interestingly, in addition to the canonical FGF receptor, the FGF21 receptor also comprises the membrane associated β-Klotho as an essential cofactor. Activation of the FGF21 receptor leads to multiple effects on a variety of metabolic parameters.

In mammals, FGFs mediate their action via a set of four FGF receptors, FGFR1-4, that in turn are expressed in multiple spliced variants, e.g., FGFR1c, FGFR2c, FGFR3c and FGFR4. Each FGF receptor contains an intracellular tyrosine kinase domain that is activated upon ligand binding, leading to downstream signaling pathways involving MAPKs (Erk1/2), RAFT, AKT1 and STATs. (Kharitonenkov et al., (2008) *BioDrugs* 22:37-44). Several reports suggested that the "c"-reporter splice variants of FGFR1-3 exhibit specific affinity to β-Klotho and could act as endogenous receptor for FGF21 (Kurosu et al., (2007) *J. Biol. Chem.* 282:26687-95); Ogawa et al., (2007) *Proc. Natl. Acad. Sci. USA* 104:7432-37); Kharitonenkov et al., (2008) *J. Cell Physiol.* 215:1-7). In the liver, which abundantly expresses both β-Klotho and FGFR4, FGF21 does not induce phosphorylation of MAPK albeit the strong binding of FGF21 to the β-Klotho-FGFR4 complex. In 3T3-L1 cells and white adipose tissue, FGFR1 is by far the most abundant receptor, and it is therefore most likely that FGF21's main functional receptors in this tissue are the β-Klotho/FGFR1c complexes.

The present disclosure provides a human (or humanized) antigen binding protein, such as a monoclonal antibody, that induces FGF21-like signaling, e.g., an agonistic antibody that mimics the function of FGF21. Such an antibody is a molecule with FGF21-like activity and selectivity but with added therapeutically desirable characteristics typical for an antibody such as protein stability, lack of immunogenicity, ease of production and long half-life in vivo.

SUMMARY

The instant disclosure provides antigen binding proteins that bind a complex comprising β-Klotho and at least one of (i) FGFR1c, (ii) FGFR2c and (iii) FGFR3c, including antigen binding proteins that induce FGF21-like signaling, as well as pharmaceutical compositions comprising antigen binding proteins that bind to a complex comprising β-Klotho and at least one of (i) FGFR1c, (ii) FGFR2c and (iii) FGFR3c, including antigen binding proteins that induce FGF21-like signaling. In another aspect, also provided are expression vectors and host cells transformed or transfected with the expression vectors that comprise the aforementioned isolated nucleic acid molecules that encode the antigen binding proteins disclosed herein. Representative heavy and light chains are provided in Tables 1A and 1B; representative variable region heavy chain and light chain sequences are provided in Tables 2A and 2B; coding sequences for the variable region of the heavy and light chains are provided in Tables 2C and 2D; Tables 3A and 3B provide CDR regions of the disclosed variable heavy and light chains, and Tables 3C and 3D provide coding sequences for the disclosed CDRs.

In another aspect, also provided are methods of preparing antigen binding proteins that specifically or selectively bind a complex comprising β-Klotho and at least one of (i) FGFR1c, (ii) FGFR2c and (iii) FGFR3c and comprise the step of preparing the antigen binding protein from a host cell that secretes the antigen binding protein.

Other embodiments provide a method of preventing or treating a condition in a subject in need of such treatment comprising administering a therapeutically effective amount of a pharmaceutical composition provided herein to a subject, wherein the condition is treatable by lowering blood glucose, insulin or serum lipid levels. In embodiments, the condition is type 2 diabetes, obesity, dyslipidemia, NASH, cardiovascular disease or metabolic syndrome.

These and other aspects are described in greater detail herein. Each of the aspects provided can encompass various embodiments provided herein. It is therefore anticipated that each of the embodiments involving one element or combinations of elements can be included in each aspect described, and all such combinations of the above aspects and embodiments are expressly considered. Other features, objects, and advantages of the disclosed antigen binding proteins and associated methods and compositions are apparent in the detailed description that follows.

BRIEF DESCRIPTION OF THE FIGURES

FIG. 3 is a plot showing the representative data from Luciferase reporter activity screens of the antibodies disclosed herein with FGF21 and a reference antibody 16H7.1 as positive controls (insert); these hybridomas were generated by immunization with cell-bound receptor of 293T transfectants expressing full length human β-Klotho and an N-terminal truncated form of human FGFR1c encompassing amino acid residue #141 to #822 polypeptide of SEQ ID NO:4. X- and Y-axis in the plot are % FGF21 activity from two independent assays (n=1 and n=2) of the same set of hybridoma samples (gray circles) showing the consistency of the assays; several hybridoma samples were also included as negative controls (black circles);

Figure 6E:
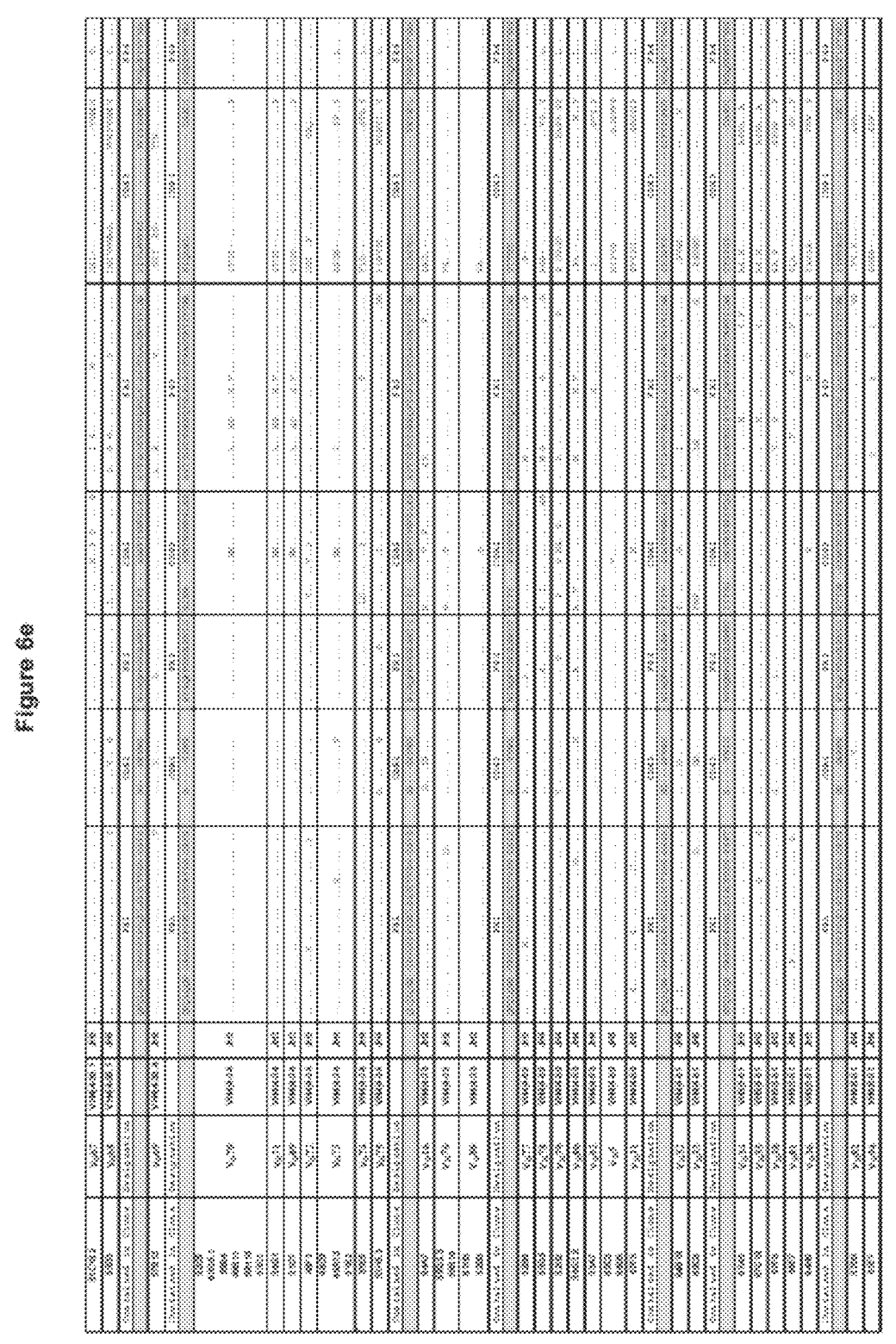

FIGS. 6a-e show the amino acid alignment of heavy and light chains of the antibodies compared to the corresponding germline V-gene sequence.

DETAILED DESCRIPTION

Figure 1A:
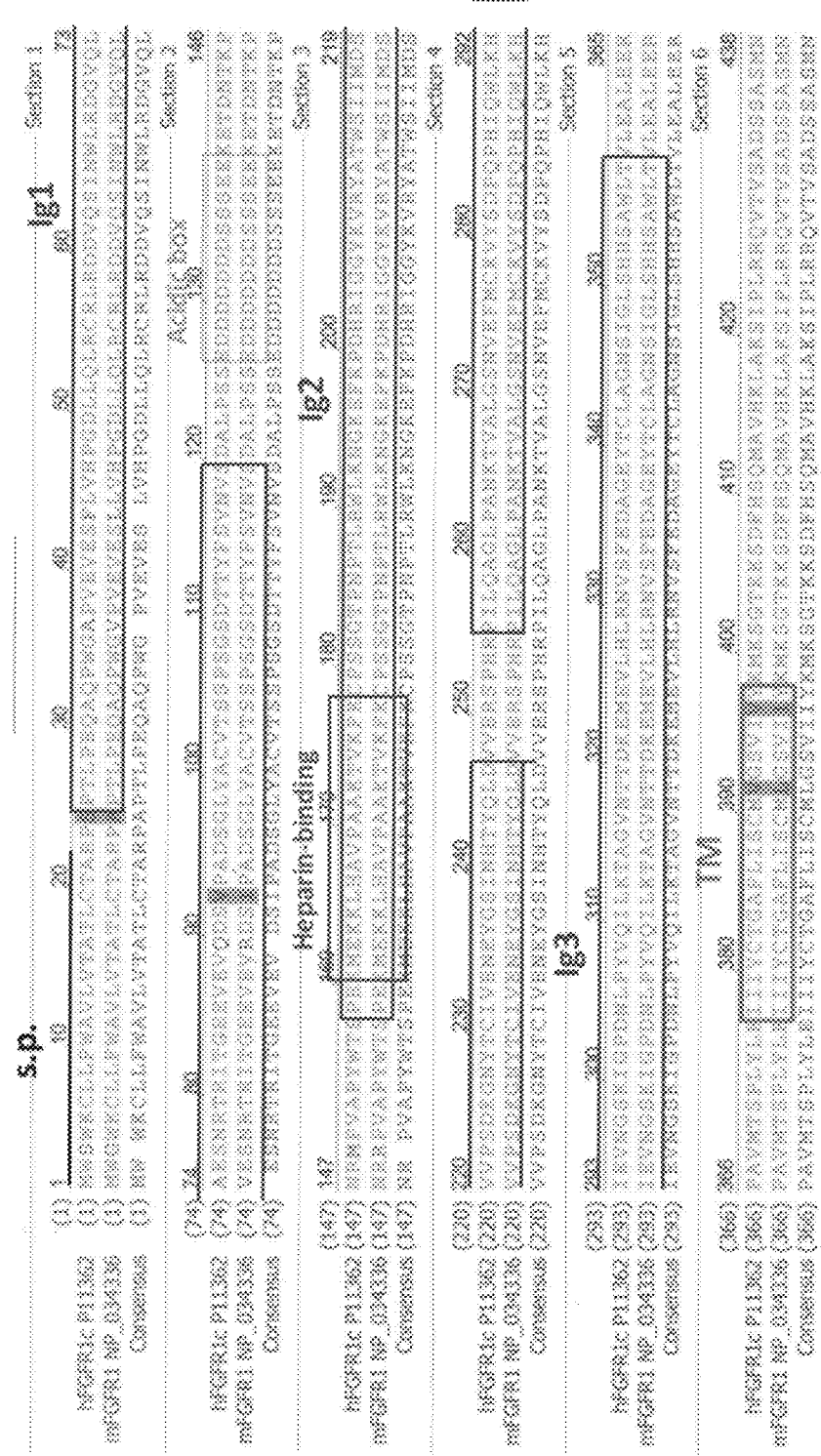
FIG. 1a-1b is an alignment showing the sequence homology between human FGFR1c (GenBank Accession No P11362; SEQ ID NO: 4) and murine FGFR1c (GenBank Accession No NP_034336; SEQ ID NO: 1832); various features are highlighted, including the signal peptide, transmembrane sequence, heparin binding region, and a consensus sequence (SEQ ID NO: 1833) is provided.

The section headings used herein are for organizational purposes only and are not to be construed as limiting the subject matter described.

Unless otherwise defined herein, scientific and technical terms used in connection with the present application shall have the meanings that are commonly understood by those of ordinary skill in the art. Further, unless otherwise required by context, singular terms shall include pluralities and plural terms shall include the singular.

Generally, nomenclatures used in connection with, and techniques of, cell and tissue culture, molecular biology, immunology, microbiology, genetics and protein and nucleic acid chemistry and hybridization described herein are those well known and commonly used in the art. The methods and techniques of the present application are generally performed according to conventional methods well known in the art and as described in various general and more specific references that are cited and discussed throughout the present specification unless otherwise indicated. See, e.g., Sambrook et al., *Molecular Cloning: A Laboratory Manual, 3rd* ed., Cold Spring Harbor Laboratory Press, Cold Spring Harbor, N.Y. (2001) and subsequent editions, Ausubel et al., *Current Protocols in Molecular Biology*, Greene Publishing Associates (1992), and Harlow & Lane, *Antibodies: A Laboratory Manual*, Cold Spring Harbor Laboratory Press, Cold Spring Harbor, N.Y. (1988), which are incorporated herein by reference. Enzymatic reactions and purification techniques are performed according to manufacturer's specifications, as commonly accomplished in the art or as described herein. The terminology used in connection with, and the laboratory procedures and techniques of, analytical chemistry, synthetic organic chemistry, and medicinal and pharmaceutical chemistry described herein are those well known and commonly used in the art. Standard techniques can be used for chemical syntheses, chemical analyses, pharmaceutical preparation, formulation, and delivery, and treatment of patients.

It should be understood that the instant disclosure is not limited to the particular methodology, protocols, and reagents, etc., described herein and as such can vary. The terminology used herein is for the purpose of describing particular embodiments only, and is not intended to limit the scope of the present disclosure.

Other than in the operating examples, or where otherwise indicated, all numbers expressing quantities of ingredients or reaction conditions used herein should be understood as modified in all instances by the term "about." The term "about" when used in connection with percentages can mean±5%, e.g., 1%, 2%, 3%, or 4%.

I. DEFINITIONS

As used herein, the terms "a" and "an" mean "one or more" unless specifically stated otherwise.

As used herein, an "antigen binding protein" is a protein comprising a portion that binds to an antigen or target and, optionally, a scaffold or framework portion that allows the antigen binding portion to adopt a conformation that promotes binding of the antigen binding protein to the antigen. Examples of antigen binding proteins include a human antibody, a humanized antibody; a chimeric antibody; a recombinant antibody; a single chain antibody; a diabody; a triabody; a tetrabody; a Fab fragment; a F(ab')$_2$ fragment; an IgD antibody; an IgE antibody; an IgM antibody; an IgG1 antibody; an IgG2 antibody; an IgG3 antibody; or an IgG4 antibody, and fragments thereof. The antigen binding protein can comprise, for example, an alternative protein scaffold or artificial scaffold with grafted CDRs or CDR derivatives. Such scaffolds include, but are not limited to, antibody-derived scaffolds comprising mutations introduced to, for example, stabilize the three-dimensional structure of the antigen binding protein as well as wholly synthetic scaffolds comprising, for example, a biocompatible polymer. See, e.g., Korndorfer et al., (2003) *Proteins: Structure, Function, and Bioinformatics*, 53(1):121-129; Roque et al., (2004) *Biotechnol. Prog.* 20:639-654. In addition, peptide antibody mimetics ("PAMs") can be used, as well as scaffolds based on antibody mimetics utilizing fibronectin components as a scaffold.

An antigen binding protein can have, for example, the structure of a naturally occurring immunoglobulin. An "immunoglobulin" is a tetrameric molecule. In a naturally occurring immunoglobulin, each tetramer is composed of two identical pairs of polypeptide chains, each pair having one "light" (about 25 kDa) and one "heavy" chain (about 50-70 kDa). The amino-terminal portion of each chain includes a variable region of about 100 to 110 or more amino acids primarily responsible for antigen recognition. The carboxy-terminal portion of each chain defines a constant region primarily responsible for effector function. Human light chains are classified as kappa and lambda light chains. Heavy chains are classified as mu, delta, gamma, alpha, or epsilon, and define the antibody's isotype as IgM, IgD, IgG, IgA, and IgE, respectively. Within light and heavy chains, the variable and constant regions are joined by a "J" region of about 12 or more amino acids, with the heavy chain also including a "D" region of about 10 more amino acids. See generally, *Fundamental Immunology* $2^{nd}$ ed. Ch. 7 (Paul, W., ed., Raven Press, N.Y. (1989)), incorporated by reference in its entirety for all purposes. The variable regions of each light/heavy chain pair form the antibody binding site such that an intact immunoglobulin has two binding sites.

Naturally occurring immunoglobulin chains exhibit the same general structure of relatively conserved framework regions (FR) joined by three hypervariable regions, also called complementarity determining regions or CDRs. From N-terminus to C-terminus, both light and heavy chains comprise the domains FR1, CDR1, FR2, CDR2, FR3, CDR3 and FR4. The assignment of amino acids to each domain can be done in accordance with the definitions of Kabat et al., (1991) "Sequences of Proteins of Immunological Interest", $5^{th}$ Ed., US Dept. of Health and Human Services, PHS, NIH, NIH Publication no. 91-3242. Although presented herein using the Kabat nomenclature system, as desired, the CDRs disclosed herein can also be redefined according an alternative nomenclature scheme, such as that of Chothia (see Chothia & Lesk, (1987) *J. Mol. Biol.* 196:901-917; Chothia et al., (1989) *Nature* 342:878-883 or Honegger & Pluckthun, (2001) *J. Mol. Biol.* 309:657-670).

In the context of the instant disclosure an antigen binding protein is said to "specifically bind" or "selectively bind" its target antigen when the dissociation constant ($K_D$) is $\leq 10^{-8}$ M. The antibody specifically binds antigen with "high affinity" when the $K_D$ is $\leq 5 \times 10^{-9}$ M, and with "very high affinity" when the $K_D$ is $\leq 5 \times 10^{-10}$ M. In one embodiment, the antibodies will bind to a complex comprising β-Klotho and an FGFR, including a complex comprising both human FGFR1c and human β-Klotho, with a $K_D$ of between about $10^{-7}$ M and $10^{-12}$ M, and in yet another embodiment the antibodies will bind with a $K_D \leq 5 \times 10^{-9}$.

An "antibody" refers to an intact immunoglobulin or to an antigen binding portion thereof that competes with the intact antibody for specific binding, unless otherwise specified. Antigen binding portions can be produced by recombinant DNA techniques or by enzymatic or chemical cleavage of intact antibodies. Antigen binding portions include, inter alia, Fab, Fab', F(ab')$_2$, Fv, domain antibodies (dAbs), fragments including complementarity determining regions (CDRs), single-chain antibodies (scFv), chimeric antibodies, diabodies, triabodies, tetrabodies, and polypeptides that contain at least a portion of an immunoglobulin that is sufficient to confer specific antigen binding to the polypeptide.

A Fab fragment is a monovalent fragment having the $V_L$, $V_H$, $C_L$ and $C_H1$ domains; a F(ab')$_2$ fragment is a bivalent fragment having two Fab fragments linked by a disulfide bridge at the hinge region; a Fd fragment has the $V_H$ and $C_H1$ domains; an Fv fragment has the $V_L$ and $V_H$ domains of a single arm of an antibody; and a dAb fragment has a $V_H$ domain, a $V_L$ domain, or an antigen-binding fragment of a $V_H$ or $V_L$ domain (U.S. Pat. Nos. 6,846,634, and 6,696,245; and U.S. application Pub. Ser. Nos. 05/202,512, 04/202,995, 04/038,291, 04/009,507, 03/039,958, Ward et al., *Nature* 341:544-546 (1989)).

A single-chain antibody (scFv) is an antibody in which a $V_L$ and a $V_H$ region are joined via a linker (e.g., a synthetic sequence of amino acid residues) to form a continuous protein chain wherein the linker is long enough to allow the protein chain to fold back on itself and form a monovalent antigen binding site (see, e.g., Bird et al., (1988) *Science* 242:423-26 and Huston et al., (1988) *Proc. Natl. Acad. Sci. USA* 85:5879-83). Diabodies are bivalent antibodies comprising two polypeptide chains, wherein each polypeptide chain comprises $V_H$ and $V_L$ domains joined by a linker that is too short to allow for pairing between two domains on the same chain, thus allowing each domain to pair with a complementary domain on another polypeptide chain (see, e.g., Holliger et al., (1993) *Proc. Natl. Acad. Sci. USA* 90:6444-48, and Poljak et al., (1994) *Structure* 2:1121-23). If the two polypeptide chains of a diabody are identical, then a diabody resulting from their pairing will have two identical antigen binding sites. Polypeptide chains having different sequences can be used to make a diabody with two different antigen binding sites. Similarly, tribodies and tetrabodies are antibodies comprising three and four polypeptide chains, respectively, and forming three and four antigen binding sites, respectively, which can be the same or different.

Complementarity determining regions (CDRs) and framework regions (FR) of a given antibody can be identified using the system described by Kabat et al., (1991) "Sequences of Proteins of Immunological Interest", $5^{th}$ Ed., US Dept. of Health and Human Services, PHS, NIH, NIH Publication no. 91-3242. Although presented using the Kabat nomenclature system, as desired, the CDRs disclosed herein can also be redefined according an alternative nomenclature scheme, such as that of Chothia (see Chothia & Lesk, (1987) *J. Mol. Biol.* 196:901-917; Chothia et al., (1989) *Nature* 342:878-883 or Honegger & Pluckthun, (2001) *J. Mol. Biol.* 309:657-670). One or more CDRs can be incorporated into a molecule either covalently or noncovalently to make it an antigen binding protein. An antigen binding protein can incorporate the CDR(s) as part of a larger polypeptide chain, can covalently link the CDR(s) to another polypeptide chain, or can incorporate the CDR(s) noncovalently. The CDRs permit the antigen binding protein to specifically bind to a particular antigen of interest.

An antigen binding protein can but need not have one or more binding sites. If there is more than one binding site, the binding sites can be identical to one another or can be different. For example, a naturally occurring human immunoglobulin typically has two identical binding sites, while a "bispecific" or "bifunctional" antibody has two different binding sites. Antigen binding proteins of this bispecific form (e.g., those comprising various heavy and light chain CDRs provided herein) comprise aspects of the instant disclosure.

The term "human antibody" includes all antibodies that have one or more variable and constant regions derived from human immunoglobulin sequences. In one embodiment, all of the variable and constant domains are derived from human immunoglobulin sequences (a fully human antibody). These antibodies can be prepared in a variety of ways, examples of which are described below, including through the immunization with an antigen of interest of a mouse that is genetically modified to express antibodies derived from human heavy and/or light chain-encoding genes, such as a mouse derived from a XENOMOUSE®, ULTIMAB™, HUMAB-MOUSE®, VELOCIMOUSE®, VELOCIMMUNE®, KYMOUSE, or ALIVAMAB system, or derived from human heavy chain transgenic mouse, transgenic rat human antibody repertoire, transgenic rabbit human antibody repertoire or cow human antibody repertoire or HUTARG™ technology. Phage-based approaches can also be employed.

A humanized antibody has a sequence that differs from the sequence of an antibody derived from a non-human species by one or more amino acid substitutions, deletions, and/or additions, such that the humanized antibody is less likely to induce an immune response, and/or induces a less severe immune response, as compared to the non-human species antibody, when it is administered to a human subject. In one embodiment, certain amino acids in the framework and constant domains of the heavy and/or light chains of the non-human species antibody are mutated to produce the humanized antibody. In another embodiment, the constant domain(s) from a human antibody are fused to the variable domain(s) of a non-human species. In another embodiment, one or more amino acid residues in one or more CDR sequences of a non-human antibody are changed to reduce the likely immunogenicity of the non-human antibody when it is administered to a human subject, wherein the changed amino acid residues either are not critical for immunospecific binding of the antibody to its antigen, or the changes to the amino acid sequence that are made are conservative changes, such that the binding of the humanized antibody to the antigen is not significantly worse than the binding of the non-human antibody to the antigen. Examples of how to make humanized antibodies can be found in U.S. Pat. Nos. 6,054,297, 5,886,152 and 5,877,293.

The term "chimeric antibody" refers to an antibody that contains one or more regions from one antibody and one or more regions from one or more other antibodies. In one embodiment, one or more of the CDRs are derived from a human antibody that binds to a complex comprising β-Klotho and at least one of (i) FGFR1c, (ii) FGFR2c and (iii) FGFR3c. In another embodiment, all of the CDRs are derived from a human antibody that binds to a complex β-Klotho and at least one of (i) FGFR1c, (ii) FGFR2c and (iii) FGFR3c. In another embodiment, the CDRs from more than one human antibody that binds to a complex comprising β-Klotho and at least one of (i) FGFR1c, (ii) FGFR2c and (iii) FGFR3c are mixed and matched in a chimeric antibody. For instance, a chimeric antibody can comprise a CDR1 from the light chain of a first human antibody that binds to a complex comprising β-Klotho and at least one of (i) FGFR1c, (ii) FGFR2c and (iii) FGFR3c, a CDR2 and a CDR3 from the light chain of a second human antibody that binds to a complex comprising β-Klotho and at least one of (i) FGFR1c, (ii) FGFR2c and (iii) FGFR3c, and the CDRs from the heavy chain from a third antibody that binds to a complex comprising β-Klotho and at least one of (i) FGFR1c, (ii) FGFR2c and (iii) FGFR3c. Further, the framework regions can be derived from one of the same antibodies that bind to a complex comprising β-Klotho and at least one of (i) FGFR1c, (ii) FGFR2c and (iii) FGFR3c, from one or more different antibodies, such as a human antibody, or from a humanized antibody. In one example of a chimeric antibody, a portion of the heavy and/or light chain is identical with, homologous to, or derived from an antibody from a particular species or belonging to a particular antibody class or subclass, while the remainder of the chain(s) is/are identical with, homologous to, or derived from an antibody or antibodies from another species or belonging to another antibody class or subclass. Also included are fragments of such antibodies that exhibit the desired biological activity (e.g., the ability to specifically bind to a complex comprising β-Klotho and at least one of (i) FGFR1c, (ii) FGFR2c and (iii) FGFR3c).

The term "light chain" includes a full-length light chain and fragments thereof having sufficient variable region sequence to confer binding specificity. A full-length light chain includes a variable region domain, $V_L$, and a constant region domain, $C_L$. The variable region domain of the light chain is at the amino-terminus of the polypeptide. Light chains include kappa ("κ") chains and lambda ("λ") chains.

The term "heavy chain" includes a full-length heavy chain and fragments thereof having sufficient variable region sequence to confer binding specificity. A full-length heavy chain includes a variable region domain, $V_H$, and three constant region domains, $C_H1$, $C_H2$, and $C_H3$. The $V_H$ domain is at the amino-terminus of the polypeptide, and the $C_H$ domains are at the carboxyl-terminus, with the $C_H3$ being closest to the carboxy-terminus of the polypeptide. Heavy chains can be of any isotype, including IgG (including IgG1, IgG2, IgG3 and IgG4 subtypes), IgA (including IgA1 and IgA2 subtypes), IgM and IgE.

The term "immunologically functional fragment" (or simply "fragment") of an antigen binding protein, e.g., an antibody or immunoglobulin chain (heavy or light chain), as used herein, is an antigen binding protein comprising a portion (regardless of how that portion is obtained or synthesized) of an antibody that lacks at least some of the amino acids present in a full-length chain but which is capable of specifically binding to an antigen. Such fragments are biologically active in that they bind specifically to the target antigen and can compete with other antigen binding proteins, including intact antibodies, for specific binding to a given epitope. In one aspect, such a fragment will retain at least one CDR present in the full-length light or heavy chain, and in some embodiments will comprise a single heavy chain and/or light chain or portion thereof. These biologically active fragments can be produced by recombinant DNA techniques, or can be produced by enzymatic or chemical cleavage of antigen binding proteins, including intact antibodies. Immunologically functional immunoglobulin fragments include, but are not limited to, Fab, Fab', F(ab')$_2$, Fv, domain antibodies and single-chain antibodies, and can be derived from any mammalian source, including but not limited to human, mouse, rat, camelid or rabbit. It is contemplated further that a functional portion of the antigen binding proteins disclosed herein, for example, one or more CDRs, could be covalently bound to a second protein or to a small molecule to create a therapeutic agent directed to a particular target in the body, possessing bifunctional therapeutic properties, or having a prolonged serum half-life.

An "Fc" region contains two heavy chain fragments comprising the $C_H2$ and $C_H3$ domains of an antibody. The two heavy chain fragments are held together by two or more disulfide bonds and by hydrophobic interactions of the $C_H3$ domains.

An "Fab' fragment" contains one light chain and a portion of one heavy chain that contains the $V_H$ domain and the $C_H1$ domain and also the region between the $C_H1$ and $C_H2$ domains, such that an interchain disulfide bond can be formed between the two heavy chains of two Fab' fragments to form an F(ab')$_2$ molecule.

An "F(ab')$_2$ fragment" contains two light chains and two heavy chains containing a portion of the constant region between the $C_H1$ and $C_H2$ domains, such that an interchain disulfide bond is formed between the two heavy chains. A F(ab')$_2$ fragment thus is composed of two Fab' fragments that are held together by a disulfide bond between the two heavy chains.

The "Fv region" comprises the variable regions from both the heavy and light chains, but lacks the constant regions.

A "domain antibody" is an immunologically functional immunoglobulin fragment containing only the variable region of a heavy chain or the variable region of a light chain. In some instances, two or more $V_H$ regions are covalently joined with a peptide linker to create a bivalent domain antibody. The two $V_H$ regions of a bivalent domain antibody can target the same or different antigens.

A "hemibody" is an immunologically-functional immunoglobulin construct comprising a complete heavy chain, a complete light chain and a second heavy chain Fc region paired with the Fc region of the complete heavy chain. A linker can, but need not, be employed to join the heavy chain Fc region and the second heavy chain Fc region. In particular embodiments a hemibody is a monovalent form of an antigen binding protein disclosed herein. In other embodiments, pairs of charged residues can be employed to associate one Fc region with the second Fc region.

A "bivalent antigen binding protein" or "bivalent antibody" comprises two antigen binding sites. In some instances, the two binding sites have the same antigen specificities. Bivalent antigen binding proteins and bivalent antibodies can be bispecific, as described herein, and form aspects of the instant disclosure.

A "multispecific antigen binding protein" or "multispecific antibody" is one that targets more than one antigen or epitope, and forms another aspect of the instant disclosure.

A "bispecific," "dual-specific" or "bifunctional" antigen binding protein or antibody is a hybrid antigen binding protein or antibody, respectively, having two different antigen binding sites. Bispecific antigen binding proteins and antibodies are a species of multispecific antigen binding protein or multispecific antibody and can be produced by a variety of methods including, but not limited to, fusion of hybridomas or linking of Fab' fragments. See, e.g., Songsivilai and Lachmann, (1990) *Clin. Exp. Immunol.* 79:315-321; Kostelny et al., (1992) *J. Immunol.* 148:1547-1553. The two binding sites of a bispecific antigen binding protein or antibody will bind to two different epitopes, which can reside on the same (e.g., β-Klotho, FGFR1c, FGFR2c, or FGFR3c) or different protein targets (e.g., 13-Klotho and one of (i) FGFR1c, (ii) FGFR2c, and (iii) FGFR3c).

The terms "FGF21-like signaling" and "induces FGF21-like signaling," when applied to an antigen binding protein of the present disclosure, means that the antigen binding protein mimics, or modulates, an in vivo biological effect induced by the binding to a complex comprising β-Klotho and at least one of (i) FGFR1c, (ii) FGFR2c and (iii) FGFR3c and induces a biological response that otherwise would result from FGF21 binding to a complex comprising β-Klotho and at least one of (i) FGFR1c, (ii) FGFR2c and (iii) FGFR3c in vivo. In assessing the binding and specificity of an antigen binding protein, e.g., an antibody or immunologically functional fragment thereof, an antibody or fragment is deemed to induce a biological response when the response is equal to or greater than 5%, and preferably equal to or greater than 10%, 15%, 20%, 25%, 30%, 35%, 40%, 45%, 50%, 55%, 60%, 65%, 70%, 75%, 80%, 85%, 90% or 95%, of the activity of a wild type FGF21 standard comprising the mature form of SEQ ID NO: 2 (i.e., the mature form of the human FGF21 sequence) and has the following properties: exhibiting an efficacy level of equal to or more than 5% of an FGF21 standard, with an $EC_{50}$ of equal to or less than 100 nM, e.g., 90 nM, 80 nM, 70 nM, 60 nM, 50 nM, 40 nM, 30 nM, 20 nM or 10 nM in (1) the recombinant FGF21 receptor-mediated luciferase reporter cell assay of Example 4; (2) ERK-phosphorylation in the recombinant FGF21 receptor mediated cell assay of Example 4; and (3) ERK-phosphorylation in human adipocytes as described in Example 4. The "potency" of an antigen binding protein is defined as exhibiting an EC50 of equal to or less than 100 nM, e.g., 90 nM, 80 nM, 70 nM, 60 nM, 50 nM, 40 nM, 30 nM, 20 nM, 10 nM and preferably less than 10 nM of the antigen binding protein in the following assays: (1) the recombinant FGF21 receptor mediated luciferase-reporter cell assay of Example 4; (2) the ERK-phosphorylation in the recombinant FGF21 receptor mediated cell assay of Example 4; and (3) ERK-phosphorylation in human adipocytes as described in Example 4.

It is noted that not all of the antigen binding proteins of the present disclosure induce FGF21-mediated signaling (e.g., that induce agonistic activity), nor is this property desirable in all circumstances. Nevertheless, antigen binding proteins that do not induce FGF21-mediated signaling form aspects of the present disclosure and may be useful as diagnostic reagents or other applications.

As used herein, the term "FGF21R" means a multimeric receptor complex that FGF21 is known or suspected to form in vivo. In various embodiments, FGF21R comprises (i) an FGFR, e.g., FGFR1c, FGFR2c, FGFR3c or FGFR4, and (ii) β-Klotho.

The term "polynucleotide" or "nucleic acid" includes both single-stranded and double-stranded nucleotide polymers. The nucleotides comprising the polynucleotide can be ribonucleotides or deoxyribonucleotides or a modified form of either type of nucleotide. Said modifications include base modifications such as bromouridine and inosine derivatives, ribose modifications such as 2',3'-dideoxyribose, and internucleotide linkage modifications such as phosphorothioate, phosphorodithioate, phosphoroselenoate, phosphorodiselenoate, phosphoroanilothioate, phoshoraniladate and phosphoroamidate.

The term "oligonucleotide" means a polynucleotide comprising 200 or fewer nucleotides. In some embodiments, oligonucleotides are 10 to 60 bases in length. In other embodiments, oligonucleotides are 12, 13, 14, 15, 16, 17, 18, 19, or 20 to 40 nucleotides in length. Oligonucleotides can be single stranded or double stranded, e.g., for use in the construction of a mutant gene. Oligonucleotides can be sense or antisense oligonucleotides. An oligonucleotide can include a label, including a radiolabel, a fluorescent label, a hapten or an antigenic label, for detection assays. Oligonucleotides can be used, for example, as PCR primers, cloning primers or hybridization probes.

An "isolated nucleic acid molecule" means a DNA or RNA of genomic, mRNA, cDNA, or synthetic origin or some combination thereof which is not associated with all or a portion of a polynucleotide in which the isolated polynucleotide is found in nature, or is linked to a polynucleotide to which it is not linked in nature. For purposes of this disclosure, it is understood that "a nucleic acid molecule comprising" a particular nucleotide sequence does not encompass intact chromosomes. Isolated nucleic acid molecules "comprising" specified nucleic acid sequences can include, in addition to the specified sequences, coding sequences for up to ten or even up to twenty other proteins or portions thereof, or can include operably linked regulatory sequences that control expression of the coding region of the recited nucleic acid sequences, and/or can include vector sequences.

Unless specified otherwise, the left-hand end of any single-stranded polynucleotide sequence discussed herein is the 5' end; the left-hand direction of double-stranded polynucleotide sequences is referred to as the 5' direction. The direction of 5' to 3' addition of nascent RNA transcripts is referred to as the transcription direction; sequence regions on the DNA strand having the same sequence as the RNA transcript that are 5' to the 5' end of the RNA transcript are referred to as "upstream sequences;" sequence regions on the DNA strand having the same sequence as the RNA transcript that are 3' to the 3' end of the RNA transcript are referred to as "downstream sequences."

The term "control sequence" refers to a polynucleotide sequence that can affect the expression and processing of coding sequences to which it is ligated. The nature of such control sequences can depend upon the host organism. In particular embodiments, control sequences for prokaryotes can include a promoter, a ribosomal binding site, and a transcription termination sequence. For example, control sequences for eukaryotes can include promoters comprising one or a plurality of recognition sites for transcription factors, transcription enhancer sequences, and transcription termination sequence. "Control sequences" can include leader sequences and/or fusion partner sequences.

The term "vector" means any molecule or entity (e.g., nucleic acid, plasmid, bacteriophage or virus) used to transfer protein coding information into a host cell.

The term "expression vector" or "expression construct" refers to a vector that is suitable for transformation of a host cell and contains nucleic acid sequences that direct and/or control (in conjunction with the host cell) expression of one or more heterologous coding regions operatively linked thereto. An expression construct can include, but is not limited to, sequences that affect or control transcription, translation, and, if introns are present, affect RNA splicing of a coding region operably linked thereto.

As used herein, "operably linked" means that the components to which the term is applied are in a relationship that allows them to carry out their inherent functions under suitable conditions. For example, a control sequence in a vector that is "operably linked" to a protein coding sequence is ligated thereto so that expression of the protein coding sequence is achieved under conditions compatible with the transcriptional activity of the control sequences.

The term "host cell" means a cell that has been transformed, or is capable of being transformed, with a nucleic acid sequence and thereby expresses a gene of interest. The term includes the progeny of the parent cell, whether or not the progeny is identical in morphology or in genetic make-up to the original parent cell, so long as the gene of interest is present.

The term "transduction" means the transfer of genes from one bacterium to another, usually by bacteriophage. "Transduction" also refers to the acquisition and transfer of eukaryotic cellular sequences by replication-defective retroviruses.

The term "transfection" means the uptake of foreign or exogenous DNA by a cell, and a cell has been "transfected" when the exogenous DNA has been introduced inside the cell membrane. A number of transfection techniques are well known in the art and are disclosed herein. See, e.g., Graham et al., (1973) *Virology* 52:456; Sambrook et al., (2001), supra; Davis et al., (1986) *Basic Methods in Molecular Biology*, Elsevier; Chu et al., (1981) *Gene* 13:197. Such techniques can be used to introduce one or more exogenous DNA moieties into suitable host cells.

The term "transformation" refers to a change in a cell's genetic characteristics, and a cell has been transformed when it has been modified to contain new DNA or RNA. For example, a cell is transformed where it is genetically modified from its native state by introducing new genetic material via transfection, transduction, or other techniques. Following transfection or transduction, the transforming DNA can recombine with that of the cell by physically integrating into a chromosome of the cell, or can be maintained transiently as an episomal element without being replicated, or can replicate independently as a plasmid. A cell is considered to have been "stably transformed" when the transforming DNA is replicated with the division of the cell.

The terms "polypeptide" or "protein" are used interchangeably herein to refer to a polymer of amino acid residues. The terms also apply to amino acid polymers in which one or more amino acid residues is an analog or mimetic of a corresponding naturally occurring amino acid, as well as to naturally occurring amino acid polymers. The terms can also encompass amino acid polymers that have been modified, e.g., by the addition of carbohydrate residues to form glycoproteins, or phosphorylated. Polypeptides and proteins can be produced by a naturally-occurring and non-recombinant cell, or polypeptides and proteins can be produced by a genetically-engineered or recombinant cell. Polypeptides and proteins can comprise molecules having the amino acid sequence of a native protein, or molecules having deletions from, additions to, and/or substitutions of one or more amino acids of the native sequence. The terms "polypeptide" and "protein" encompass antigen binding proteins that specifically or selectively bind to a complex comprising β-Klotho and an FGFR (e.g., FGFR1c, FGFR2c or FGFR3c), or sequences that have deletions from, additions to, and/or substitutions of one or more amino acids of an antigen binding protein that specifically or selectively binds to a complex comprising β-Klotho and at least one of (i) FGFR1c, (ii) FGFR2c and (iii) FGFR3c. The term "polypeptide fragment" refers to a polypeptide that has an amino-terminal deletion, a carboxyl-terminal deletion, and/or an internal deletion as compared with the full-length protein. Such fragments can also contain modified amino acids as compared with the full-length protein. In certain embodiments, fragments are about five to 500 amino acids long. For example, fragments can be at least 5, 6, 8, 10, 14, 20, 50, 70, 100, 110, 150, 200, 250, 300, 350, 400, or 450 amino acids long. Useful polypeptide fragments include immunologically functional fragments of antibodies, including binding domains. In the case of an antigen binding protein that binds to a complex β-Klotho and at least one of (i) FGFR1c, (ii) FGFR2c and (iii) FGFR3c, useful fragments include but are not limited to a CDR region, a variable domain of a heavy or light chain, a portion of an antibody chain or just its variable region including two CDRs, and the like.

The term "isolated protein" referred means that a subject protein (1) is free of at least some other proteins with which it would normally be found, (2) is essentially free of other proteins from the same source, e.g., from the same species, (3) is expressed by a cell from a different species, (4) has been separated from at least about 50 percent of polynucleotides, lipids, carbohydrates, or other materials with which it is associated in nature, (5) is operably associated (by covalent or noncovalent interaction) with a polypeptide with which it is not associated in nature, or (6) does not occur in nature. Typically, an "isolated protein" constitutes at least about 5%, at least about 10%, at least about 25%, or at least about 50% of a given sample. Genomic DNA, cDNA, mRNA or other RNA, of synthetic origin, or any combination thereof can encode such an isolated protein. Preferably, the isolated protein is substantially free from proteins or polypeptides or other contaminants that are found in its natural environment that would interfere with its therapeutic, diagnostic, prophylactic, research or other use.

A "variant" of a polypeptide (e.g., an antigen binding protein, or an antibody) comprises an amino acid sequence wherein one or more amino acid residues are inserted into, deleted from and/or substituted into the amino acid sequence relative to another polypeptide sequence. Variants include fusion proteins.

A "derivative" of a polypeptide is a polypeptide (e.g., an antigen binding protein, or an antibody) that has been chemically modified in some manner distinct from insertion, deletion, or substitution variants, e.g., by conjugation to another chemical moiety.

The term "naturally occurring" as used throughout the specification in connection with biological materials such as polypeptides, nucleic acids, host cells, and the like, refers to materials which are found in nature.

"Antigen binding region" means a protein, or a portion of a protein, that specifically binds a specified antigen, e.g., a complex comprising β-Klotho and anβ-Klotho and at least one of (i) FGFR1c, (ii) FGFR2c and (iii) FGFR3c. For example, that portion of an antigen binding protein that contains the amino acid residues that interact with an antigen and confer on the antigen binding protein its specificity and affinity for the antigen is referred to as "antigen binding region." An antigen binding region typically includes one or more "complementary binding regions" ("CDRs"). Certain antigen binding regions also include one or more "framework" regions. A "CDR" is an amino acid sequence that contributes to antigen binding specificity and affinity. "Framework" regions can aid in maintaining the proper conformation of the CDRs to promote binding between the antigen binding region and an antigen.

In certain aspects, recombinant antigen binding proteins that bind to a complex comprising β-Klotho and at least one of (i) FGFR1c, (ii) FGFR2c and (iii) FGFR3c, are provided. In this context, a "recombinant protein" is a protein made using recombinant techniques, i.e., through the expression of a recombinant nucleic acid as described herein. Methods and techniques for the production of recombinant proteins are well known in the art.

The term "compete" when used in the context of antigen binding proteins (e.g., neutralizing antigen binding proteins, neutralizing antibodies, agonistic antigen binding proteins, agonistic antibodies and binding proteins that bind to a complex comprising β-Klotho and at least one of (i) FGFR1c, (ii) FGFR2c and (iii) FGFR3c) that compete for the same epitope or binding site on a target means competition between antigen binding proteins as determined by an assay in which the antigen binding protein (e.g., antibody or immunologically functional fragment thereof) under study prevents or inhibits the specific binding of a reference molecule (e.g., a reference ligand, or reference antigen binding protein, such as a reference antibody) to a common antigen (e.g., FGFR1c, FGFR2c, FGFR3c, 13-Klotho or a fragment thereof, or a complex comprising β-Klotho and at least one of (i) FGFR1c, (ii) FGFR2c and (iii) FGFR3c). Numerous types of competitive binding assays can be used to determine if a test molecule competes with a reference molecule for binding. Examples of assays that can be employed include solid phase direct or indirect radioimmunoassay (RIA), solid phase direct or indirect enzyme immunoassay (EIA), sandwich competition assay (see, e.g., Stahli et al., (1983) *Methods in Enzymology* 9:242-253); solid phase direct biotin-avidin EIA (see, e.g., Kirkland et al., (1986) *J. Immunol.* 137:3614-3619) solid phase direct labeled assay, solid phase direct labeled sandwich assay (see, e.g., Harlow and Lane, (1988) supra); solid phase direct label RIA using 1-125 label (see, e.g., Morel et al., (1988) *Molec. Immunol.* 25:7-15); solid phase direct biotin-avidin EIA (see, e.g., Cheung, et al., (1990) *Virology* 176:546-552); and direct labeled RIA (Moldenhauer et al., (1990) *Scand. J. Immunol.* 32:77-82). Typically, such an assay involves the use of a purified antigen bound to a solid surface or cells bearing either of an unlabelled test antigen binding protein or a labeled reference antigen binding protein. Competitive inhibition is measured by determining the amount of label bound to the solid surface or cells in the presence of the test antigen binding protein. Usually the test antigen binding protein is present in excess. Antigen binding proteins identified by competition assay (competing antigen binding proteins) include antigen binding proteins binding to the same epitope as the reference antigen binding proteins and antigen binding proteins binding to an adjacent epitope sufficiently proximal to the epitope bound by the reference antigen binding protein for steric hindrance to occur. Additional details regarding methods for determining competitive binding are provided in the examples herein. Usually, when a competing antigen binding protein is present in excess, it will inhibit specific binding of a reference antigen binding protein to a common antigen by at least 40%, 45%, 50%, 55%, 60%, 65%, 70% or 75%. In some instance, binding is inhibited by at least 80%, 85%, 90%, 95%, or 97% or more.

The term "antigen" refers to a molecule or a portion of a molecule capable of being bound by a selective binding agent, such as an antigen binding protein (including, e.g., an antibody or immunological functional fragment thereof), and may also be capable of being used in an animal to produce antibodies capable of binding to that antigen. An antigen can possess one or more epitopes that are capable of interacting with different antigen binding proteins, e.g., antibodies.

The term "epitope" means the amino acids of a target molecule that are contacted by an antigen binding protein (for example, an antibody) when the antigen binding protein is bound to the target molecule. The term includes any subset of the complete list of amino acids of the target molecule that are contacted when an antigen binding protein, such as an antibody, is bound to the target molecule. An epitope can be contiguous or non-contiguous (e.g., (i) in a single-chain polypeptide, amino acid residues that are not contiguous to one another in the polypeptide sequence but that within in context of the target molecule are bound by the antigen binding protein, or (ii) in a multimeric receptor comprising two or more individual components, e.g., a complex comprising β-Klotho and at least one of (i) FGFR1c, (ii) FGFR2c and (iii) FGFR3c, amino acid residues that are present on one or more of the individual components, but which are still bound by the antigen binding protein). In certain embodiments, epitopes can be mimetic in that they comprise a three dimensional structure that is similar to an antigenic epitope used to generate the antigen binding protein, yet comprise none or only some of the amino acid residues found in that epitope used to generate the antigen binding protein. Most often, epitopes reside on proteins, but in some instances can reside on other kinds of molecules, such as nucleic acids. Epitope determinants can include chemically active surface groupings of molecules such as amino acids, sugar side chains, phosphoryl or sulfonyl groups, and can have specific three dimensional structural characteristics, and/or specific charge characteristics. Generally, antigen binding proteins specific for a particular target molecule will preferentially recognize an epitope on the target molecule in a complex mixture of proteins and/or macromolecules.

The term "identity" refers to a relationship between the sequences of two or more polypeptide molecules or two or more nucleic acid molecules, as determined by aligning and comparing the sequences. "Percent identity" means the percent of identical residues between the amino acids or nucleotides in the compared molecules and is calculated based on the size of the smallest of the molecules being compared. For these calculations, gaps in alignments (if any) must be addressed by a particular mathematical model or computer program (i.e., an "algorithm"). Methods that can be used to calculate the identity of the aligned nucleic acids or polypeptides include those described in *Computational Molecular Biology*, (Lesk, A. M., ed.), (1988) New York: Oxford University Press; *Biocomputing Informatics and Genome Projects*, (Smith, D. W., ed.), 1993, New York: Academic Press; *Computer Analysis of Sequence Data, Part I*, (Griffin, A. M., and Griffin, H. G., eds.), 1994, New Jersey: Humana Press; von Heinje, G., (1987) *Sequence Analysis in Molecular Biology*, New York: Academic Press; *Sequence Analysis Primer*, (Gribskov, M. and Devereux, J., eds.), 1991, New York: M. Stockton Press; and Carillo et al., (1988) *J. Applied Math.* 48:1073.

In calculating percent identity, the sequences being compared are aligned in a way that gives the largest match between the sequences. The computer program used to determine percent identity is the GCG program package, which includes GAP (Devereux et al., (1984) *Nucl. Acid Res.* 12:387; Genetics Computer Group, University of Wisconsin, Madison, Wis.). The computer algorithm GAP is used to align the two polypeptides or polynucleotides for which the percent sequence identity is to be determined. The sequences are aligned for optimal matching of their respective amino acid or nucleotide (the "matched span", as determined by the algorithm). A gap opening penalty (which is calculated as 3× the average diagonal, wherein the "average diagonal" is the average of the diagonal of the comparison matrix being used; the "diagonal" is the score or number assigned to each perfect amino acid match by the particular comparison matrix) and a gap extension penalty (which is usually ⅟₁₀ times the gap opening penalty), as well as a comparison matrix such as PAM 250 or BLOSUM 62 are used in conjunction with the algorithm. In certain embodiments, a standard comparison matrix (see, Dayhoff et al., (1978) *Atlas of Protein Sequence and Structure* 5:345-352 for the PAM 250 comparison matrix; Henikoff et al., (1992) *Proc. Natl. Acad. Sci. U.S.A.* 89:10915-10919 for the BLOSUM 62 comparison matrix) is also used by the algorithm.

Recommended parameters for determining percent identity for polypeptides or nucleotide sequences using the GAP program are the following:

Algorithm: Needleman et al., 1970, *J. Mol. Biol.* 48:443-453;

Comparison matrix: BLOSUM 62 from Henikoff et al., 1992, supra;

Gap Penalty: 12 (but with no penalty for end gaps)

Gap Length Penalty: 4

Threshold of Similarity: 0

Certain alignment schemes for aligning two amino acid sequences can result in matching of only a short region of the two sequences, and this small aligned region can have very high sequence identity even though there is no significant relationship between the two full-length sequences. Accordingly, the selected alignment method (e.g., the GAP program) can be adjusted if so desired to result in an alignment that spans at least 50 contiguous amino acids of the target polypeptide.

As used herein, "substantially pure" means that the described species of molecule is the predominant species present, that is, on a molar basis it is more abundant than any other individual species in the same mixture. In certain embodiments, a substantially pure molecule is a composition wherein the object species comprises at least 50% (on a molar basis) of all macromolecular species present. In other embodiments, a substantially pure composition will comprise at least 80%, 85%, 90%, 95%, or 99% of all macromolecular species present in the composition. In other embodiments, the object species is purified to essential homogeneity wherein contaminating species cannot be detected in the composition by conventional detection methods and thus the composition consists of a single detectable macromolecular species.

The terms "treat" and "treating" refer to any indicia of success in the treatment or amelioration of an injury, pathology or condition, including any objective or subjective parameter such as abatement; remission; diminishing of symptoms or making the injury, pathology or condition more tolerable to the patient; slowing in the rate of degeneration or decline; making the final point of degeneration less debilitating; improving a patient's physical or mental well-being. The treatment or amelioration of symptoms can be based on objective or subjective parameters; including the results of a physical examination, neuropsychiatric exams, and/or a psychiatric evaluation. For example, certain methods presented herein can be employed to treat Type 2 diabetes, obesity and/or dyslipidemia, either prophylactically or as an acute treatment, to decrease plasma glucose levels, to decrease circulating triglyceride levels, to decrease circulating cholesterol levels and/or ameliorate a symptom associated with type 2 diabetes, obesity and dyslipidemia.

An "effective amount" is generally an amount sufficient to reduce the severity and/or frequency of symptoms, eliminate the symptoms and/or underlying cause, prevent the occurrence of symptoms and/or their underlying cause, and/or improve or remediate the damage that results from or is associated with diabetes, obesity and dyslipidemia. In some embodiments, the effective amount is a therapeutically effective amount or a prophylactically effective amount. A "therapeutically effective amount" is an amount sufficient to remedy a disease state (e.g., diabetes, obesity or dyslipidemia) or symptoms, particularly a state or symptoms associated with the disease state, or otherwise prevent, hinder, retard or reverse the progression of the disease state or any other undesirable symptom associated with the disease in any way whatsoever. A "prophylactically effective amount" is an amount of a pharmaceutical composition that, when administered to a subject, will have the intended prophylactic effect, e.g., preventing or delaying the onset (or reoccurrence) of diabetes, obesity or dyslipidemia, or reducing the likelihood of the onset (or reoccurrence) of diabetes, obesity or dyslipidemia or associated symptoms. The full therapeutic or prophylactic effect does not necessarily occur by administration of one dose, and may occur only after administration of a series of doses. Thus, a therapeutically or prophylactically effective amount can be administered in one or more administrations.

"Amino acid" takes its normal meaning in the art. The twenty naturally-occurring amino acids and their abbreviations follow conventional usage. See, *Immunology-A Synthesis*, $2^{nd}$ Edition, (E. S. Golub and D. R. Green, eds.), Sinauer Associates: Sunderland, Mass. (1991), incorporated herein by reference for any purpose. Stereoisomers (e.g., D-amino acids) of the twenty conventional amino acids, unnatural or non-naturally occurring or encoded amino acids such as α-,α-disubstituted amino acids, N-alkyl amino acids, and other unconventional amino acids can also be suitable components for polypeptides and are included in the phrase "amino acid." Examples of non-natural and non-naturally encoded amino acids (which can be substituted for any naturally-occurring amino acid found in any sequence disclosed herein, as desired) include: 4-hydroxyproline, γ-carboxyglutamate, ε-N,N,N-trimethyllysine, ε-N-acetyllysine, O-phosphoserine, N-acetylserine, N-formylmethionine, 3-methylhistidine, 5-hydroxylysine, σ-N-methylarginine, and other similar amino acids and imino acids (e.g., 4-hydroxyproline). In the polypeptide notation used herein, the left-hand direction is the amino terminal direction and the right-hand direction is the carboxyl-terminal direction, in accordance with standard usage and convention. A non-limiting lists of examples of non-naturally occurring/encoded amino acids that can be inserted into an antigen binding protein sequence or substituted for a wild-type residue in an antigen binding sequence include β-amino acids, homoamino acids, cyclic amino acids and amino acids with derivatized side chains. Examples include (in the L-form or D-form; abbreviated as in parentheses): citrulline (Cit), homocitrulline (hCit), Nα-methylcitrulline (NMeCit), Nα-methylhomocitrulline (Nα-MeHoCit), ornithine (Orn), Nα-Methylornithine (Nα-MeOrn or NMeOrn), sarcosine (Sar), homolysine (hLys or hK), homoarginine (hArg or hR), homoglutamine (hQ), Nα-methylarginine (NMeR), Nα-methylleucine (Nα-MeL or NMeL), N-methylhomolysine (NMeHoK), Nα-methylglutamine (NMeQ), norleucine (Nle), norvaline (Nva), 1,2,3,4-tetrahydroisoquinoline (Tic), Octahydroindole-2-carboxylic acid (Oic), 3-(1-naphthyl) alanine (1-Nal), 3-(2-naphthyl)alanine (2-Nal), 1,2,3,4-tetrahydroisoquinoline (Tic), 2-indanylglycine (IgI), para-iodophenylalanine (pI-Phe), para-aminophenylalanine (4AmP or 4-Amino-Phe), 4-guanidino phenylalanine (Guf), glycyllysine (abbreviated "K(Nε-glycyl)" or "K(glycyl)" or "K(gly)"), nitrophenylalanine (nitrophe), aminophenylalanine (aminophe or Amino-Phe), benzylphenylalanine (benzylphe), γ-carboxyglutamic acid (γ-carboxyglu), hydroxyproline (hydroxypro), p-carboxyl-phenylalanine (Cpa), α-aminoadipic acid (Aad), Nα-methyl valine (NMeVal), N-α-methyl leucine (NMeLeu), Nα-methylnorleucine (NMeNle), cyclopentylglycine (Cpg), cyclohexylglycine (Chg), acetylarginine (acetylarg), α, β-diaminopropionoic acid (Dpr), α,γ-diaminobutyric acid (Dab), diaminopropionic acid (Dap), cyclohexylalanine (Cha), 4-methyl-phenylalanine (MePhe), β,β-diphenyl-alanine (BiPhA), aminobutyric acid (Abu), 4-phenyl-phenylalanine (or biphenylalanine; 4Bip), α-amino-isobutyric acid (Aib), beta-alanine, beta-aminopropionic acid, piperidinic acid, aminocaprioic acid, aminoheptanoic acid, aminopimelic acid, desmosine, diaminopimelic acid, N-ethylglycine, N-ethylaspargine, hydroxylysine, allo-hydroxylysine, isodesmosine, allo-isoleucine, N-methylglycine, N-methylisoleucine, N-methylvaline, 4-hydroxyproline (Hyp), γ-carboxyglutamate, ε-N,N,N-trimethyllysine, ε-N-acetyllysine, O-phosphoserine, N-acetylserine, N-formylmethionine, 3-methylhistidine, 5-hydroxylysine, ω-methylarginine, 4-Amino-O-Phthalic Acid (4APA), and other similar amino acids, and derivatized forms of any of those specifically listed.

II. GENERAL OVERVIEW

Antigen-binding proteins that bind to a complex comprising β-Klotho and at least one of (i) FGFR1c, (ii) FGFR2c and (iii) FGFR3c are provided herein. A unique property of the antigen binding proteins disclosed herein is the agonistic nature of these proteins, specifically the ability to mimic the in vivo effect of FGF21 and to induce FGF21-like signaling. More remarkably and specifically, some of the antigen binding proteins disclosed herein induce FGF21-like signaling in several in vitro cell-based assay, including the ELK-luciferase reporter assay of Example 4 under the following conditions: (1) the binding to and activity of the FGF21 receptor is β-Klotho dependent; (2) the activity is selective to the FGFR/β-Klotho complex; (3) the binding to the FGFR1c/βKlotho complex triggers FGF21-like signaling pathways; and (4) the potency (EC50) is comparable to a wild-type FGF21 standard comprising the mature form of SEQ ID NO: 2, as measured in the following cell-based assays: (1) the recombinant FGF21 receptor mediated luciferase-reporter cell assay of Example 4; (2) the ERK-phosphorylation in the recombinant FGF21 receptor mediated cell assay of Example 4; and (3) ERK-phosphorylation in human adipocytes as described in more details in Example 6. The disclosed antigen binding proteins, therefore, are expected to exhibit activities in vivo that are consistent with the natural biological function of FGF21. This property makes the disclosed antigen binding proteins viable therapeutics for the treatment of metabolic diseases such as type 2 diabetes, obesity, dyslipidemia, NASH, cardiovascular disease, metabolic syndrome and broadly any disease or condition in which it is desirable to mimic or augment the in vivo effects of FGF21.

In some embodiments of the present disclosure the antigen binding proteins provided can comprise polypeptides into which one or more complementary determining regions (CDRs) can be embedded and/or joined. In such antigen binding proteins, the CDRs can be embedded into a "framework" region, which orients the CDR(s) such that the proper antigen binding properties of the CDR(s) is achieved. In general, such antigen binding proteins that are provided can facilitate or enhance the interaction between an FGFR (e.g., FGFR1c, FGFR2c or FGFR3c) and β-Klotho, and can substantially induce FGF21-like signaling. Accordingly, the antigen binding proteins provided herein mimic the in vivo role of FGF21 and are thus "agonistic" and offer potential therapeutic benefit for the range of conditions which benefit from FGF21 therapy, including type 2 diabetes, obesity, dyslipidemia, NASH, cardiovascular disease, metabolic syndrome and broadly any disease or condition in which it is desirable to mimic or augment the in vivo effects of FGF21.

Certain antigen binding proteins described herein are antibodies or are derived from antibodies. In certain embodiments, the polypeptide structure of the antigen binding proteins is based on antibodies, including, but not limited to, monoclonal antibodies, bispecific antibodies, minibodies, domain antibodies, synthetic antibodies (sometimes referred to herein as "antibody mimetics"), chimeric antibodies, humanized antibodies, human antibodies, antibody fusions (sometimes referred to herein as "antibody conjugates"), hemibodies and fragments thereof. The various structures are further described herein below.

The antigen binding proteins provided herein have been demonstrated to bind to a complex comprising β-Klotho and at least one of (i) FGFR1c, (ii) FGFR2c and (iii) FGFR3c, and particularly to a complex comprising human β-Klotho and a human FGFR (e.g., a human FGFR1c, a human FGFR2c or a human FGFR3c). As described and shown in the Examples presented herein, based Western blot results, known commercially-available anti-β-Klotho or anti- FGFR1c antibodies bind to denatured β-Klotho or FGFR1c whereas the antigen binding protein (which are agonistic antibodies) do not. Conversely, the provided antigen binding proteins recognize the native structure of the FGFR1c and β-Klotho on the cell surface whereas the commercial antibodies do not. The antigen binding proteins that are provided therefore mimic the natural in vivo biological activity of FGF21. As a consequence, the antigen binding proteins provided herein are capable of activating FGF21-like signaling activity. In particular, the disclosed antigen binding proteins can have one or more of the following activities in vivo: induction of FGF21-like signal transduction pathways, lowering blood glucose levels, lowering circulating lipid levels, improving metabolic parameters and other physiological effects induced in vivo by the formation of the ternary complex of an FGFR (e.g., FGFR1c, FGFR2c or FGFR3c), β-Klotho and FGF21, for example conditions such as type 2 diabetes, obesity, dyslipidemia, NASH, cardiovascular disease, and metabolic syndrome.

The antigen binding proteins that specifically bind to a complex comprising β-Klotho and at least one of (i) FGFR1c, (ii) FGFR2c and (iii) FGFR3c that are disclosed herein have a variety of utilities. Some of the antigen binding proteins, for instance, are useful in specific binding assays, in the affinity purification of a complex comprising β-Klotho and at least one of (i) FGFR1c, (ii) FGFR2c and (iii) FGFR3c, including the human forms of these disclosed proteins, and in screening assays to identify other agonists of FGF21-like signaling activity.

The antigen binding proteins that specifically bind to a complex comprising β-Klotho and at least one of (i) FGFR1c, (ii) FGFR2c and (iii) FGFR3c that are disclosed herein can be used in a variety of treatment applications, as explained herein. For example, certain antigen binding proteins are useful for treating conditions associated with FGF21-like signaling processes in a patient, such as reducing, alleviating, or treating type 2 diabetes, obesity, dyslipidemia, NASH, cardiovascular disease, and metabolic syndrome. Other uses for the antigen binding proteins include, for example, diagnosis of diseases or conditions associated with β-Klotho, FGFR1c, FGFR2c, FGFR3c, FGFR4 or FGF21, and screening assays to determine the presence or absence of these molecules. Some of the antigen binding proteins described herein can be useful in treating conditions, symptoms and/or the pathology associated with decreased FGF21-like signaling activity. Exemplary conditions include, but are not limited to, diabetes, obesity, NASH and dyslipidemia.

FGF21

The antigen binding proteins disclosed herein induce FGF21-mediated signaling, as defined herein. In vivo, the mature form of FGF21 is the active form of the molecule. The nucleotide sequence encoding full length FGF21 is provided; the nucleotides encoding the signal sequence are underlined.

```
                                             (SEQ ID NO: 1)
ATG GAC TCG GAC GAG ACC GGG TTC GAG CAC TCA GGA

CTG TGG GTT TCT GTG CTG GCT GGT CTT CTG CTG GGA

GCC TGC CAG GCA CAC CCC ATC CCT GAC TCC AGT CCT

CTC CTG CAA TTC GGG GGC CAA GTC CGG CAG CGG TAC

CTC TAC ACA GAT GAT GCC CAG CAG ACA GAA GCC CAC
```

```
                          -continued
CTG GAG ATC AGG GAG GAT GGG ACG GTG GGG GGC GCT

GCT GAC CAG AGC CCC GAA AGT CTC CTG CAG CTG AAA

GCC TTG AAG CCG GGA GTT ATT CAA ATC TTG GGA GTC

AAG ACA TCC AGG TTC CTG TGC CAG CGG CCA GAT GGG

GCC CTG TAT GGA TCG CTC CAC TTT GAC CCT GAG GCC

TGC AGC TTC CGG GAG CTG CTT CTT GAG GAC GGA TAC

AAT GTT TAC CAG TCC GAA GCC CAC GGC CTC CCG CTG

CAC CTG CCA GGG AAC AAG TCC CCA CAC CGG GAC CCT

GCA CCC CGA GGA CCA GCT CGC TTC CTG CCA CTA CCA

GGC CTG CCC CCC GCA CCC CCG GAG CCA CCC GGA ATC

CTG GCC CCC CAG CCC CCC GAT GTG GGC TCC TCG GAC

CCT CTG AGC ATG GTG GGA CCT TCC CAG GGC CGA AGC

CCC AGC TAC GCT TCC TGA
```

The amino acid sequence of full length FGF21 is provided; the amino acids that make up the signal sequence are underlined:

```
                                             (SEQ ID NO: 2)
M D S D E T G F E H S G L W V S V L A G L L L G A

C Q A H P I P D S S P L L Q F G G Q V R Q R Y L Y

T D D A Q Q T E A H L E I R E D G T V G G A A D Q

S P E S L L Q L K A L K P G V I Q I L G V K T S R

F L C Q R P D G A L Y G S L H F D P E A C S F R E

L L L E D G Y N V Y Q S E A H G L P H L P G N K

S P H R D P A P R G P A R F L P L P G L P P A P P

E P P G I L A P Q P P D V G S S D P L S M V G P S

Q G R S P S Y A S
```

FGFR1c

The antigen binding proteins disclosed herein bind to FGFR1c, in particular human FGFR1c, when associated with β-Klotho. The nucleotide sequence encoding human FGFR1c (GenBank Accession Number NM_023110) is provided:

```
                                             (SEQ ID NO: 3)
ATGTGGAGCTGGAAGTGCCTCCTCTTCTGGGCTGTGCTGGTCACAG

CCACACTCTGCACCGCTAGGCCGTCCCCGACCTTGCCTGAACAAGC

CCAGCCCTGGGGAGCCCCTGTGGAAGTGGAGTCCTTCCTGGTCCAC

CCCGGTGACCTGCTGCAGCTTCGCTGTCGGCTGCGGGACGATGTGC

AGAGCATCAACTGGCTGCGGGACGGGGTGCAGCTGGCGGAAAGCA

ACCGCACCCGCATCACAGGGGAGGAGGTGGAGGTGCAGGACTCCG

TGCCCGCAGACTCCGGCCTCTATGCTTGCGTAACCAGCAGCCCCTC

GGGCAGTGACACCACCTACTTCTCCGTCAATGTTTCAGATGCTCTCC

CCTCCTCGGAGGATGATGATGATGATGATGACTCCTCTTCAGAGGA

GAAAGAAACAGATAACACCAAACCAAACCGTATGCCCGTAGCTCC
```

```
ATATTGGACATCACCAGAAAAGATGGAAAAGAAATTGCATGCAGT

GCCGGCTGCCAAGACAGTGAAGTTCAAATGCCCTTCCAGTGGGACA

CCAAACCCAACACTGCGCTGGTTGAAAAATGGCAAAGAATTCAAA

CCTGACCACAGAATTGGAGGCTACAAGGTCCGTTATGCCACCTGGA

GCATCATAATGGACTCTGTGGTGCCCTCTGACAAGGGCAACTACAC

CTGCATTGTGGAGAATGAGTACGGCAGCATCAACCACACATACCA

GCTGGATGTCGTGGAGCGGTCCCCTCACCGGCCCATCCTGCAAGCA

GGGTTGCCCGCCAACAAAACAGTGGCCCTGGGTAGCAACGTGGAG

TTCATGTGTAAGGTGTACAGTGACCCGCAGCCGCACATCCAGTGGC

TAAAGCACATCGAGGTGAATGGGAGCAAGATTGGCCCAGACAACC

TGCCTTATGTCCAGATCTTGAAGACTGCTGGAGTTAATACCACCGA

CAAAGAGATGGAGGTGCTTCACTTAAGAAATGTCTCCTTTGAGGAC

GCAGGGGAGTATACGTGCTTGGCGGGTAACTCTATCGGACTCTCCC

ATCACTCTGCATGGTTGACCGTTCTGGAAGCCCTGGAAGAGAGGCC

GGCAGTGATGACCTCGCCCCTGTACCTGGAGATCATCATCTATTGC

ACAGGGGCCTTCCTCATCTCCTGCATGGTGGGGTCGGTCATCGTCT

ACAAGATGAAGAGTGGTACCAAGAAGAGTGACTTCCACAGCCAGA

TGGCTGTGCACAAGCTGGCCAAGAGCATCCCTCTGCGCAGACAGGT

AACAGTGTCTGCTGACTCCAGTGCATCCATGAACTCTGGGGTTCTT

CTGGTTCGGCCATCACGGCTCTCCTCCAGTGGGACTCCATGCTAG

CAGGGGTCTCTGAGTATGAGCTTCCCGAAGACCCTCGCTGGGAGCT

GCCTCGGGACAGACTGGTCTTAGGCAAACCCCTGGGAGAGGGCTG

CTTTGGGCAGGTGGTGTTGGCAGAGGCTATCGGGCTGGACAAGGA

CAAACCCAACCGTGTGACCAAAGTGGCTGTGAAGATGTTGAAGTC

GGACGCAACAGAGAAAGACTTGTCAGACCTGATCTCAGAAATGGA

GATGATGAAGATGATCGGGAAGCATAAGAATATCATCAACCTGCT

GGGGGCCTGCACGCAGGATGGTCCCTTGTATGTCATCGTGGAGTAT

GCCTCCAAGGGCAACCTGCGGGAGTACCTGCAGGCCCGGAGGCCC

CCAGGGCTGGAATACTGCTACAACCCCAGCCACAACCCAGAGGAG

CAGCTCTCCTCCAAGGACCTGGTGTCCTGCGCCTACCAGGTGGCCC

GAGGCATGGAGTATCTGGCCTCCAAGAAGTGCATACACCGAGACC

TGGCAGCCAGGAATGTCCTGGTGACAGAGGACAATGTGATGAAGA

TAGCAGACTTTGGCCTCGCACGGGACATTCACCACATCGACTACTA

TAAAAAGACAACCAACGGCCGACTGCCTGTGAAGTGGATGGCACC

CGAGGCATTATTTGACCGGATCTACACCCACCAGAGTGATGTGTGG

TCTTTCGGGGTGCTCCTGTGGGAGATCTTCACTCTGGGCGGCTCCCC

ATACCCCGGTGTGCCTGTGGAGGAACTTTTCAAGCTGCTGAAGGAG

GGTCACCGCATGGACAAGCCCAGTAACTGCACCAACGAGCTGTAC

ATGATGATGCGGGACTGCTGGCATGCAGTGCCCTCACAGAGACCCA

CCTTCAAGCAGCTGGTGGAAGACCTGGACCGCATCGTGGCCTTGAC

CTCCAACCAGGAGTACCTGGACCTGTCCATGCCCCTGGACCAGTAC

TCCCCCAGCTTTCCCGACACCCGGAGCTCTACGTGCTCCTCAGGGG

AGGATTCCGTCTTCTCTCATGAGCCGCTGCCCGAGGAGCCCTGCCT

GCCCCGACACCCAGCCCAGCTTGCCAATGGCGGACTCAAACGCCGC

TGA.
```

The amino acid sequence of human FGFR1c (GenBank Accession Number NP_075598) is provided:

(SEQ ID NO: 4)
MWSWKCLLFWAVLVTATLCTARPSPTLPEQAQPWGAPVEVESFLVHP
GDLLQLRCRLRDDVQSINWLRDGVQLAESNRTRITGEEVEVQDSVPA
DSGLYACVTSSPSGSDTTYFSVNVSDALPSSEDDDDDDSSSEEKETD
NTKPNRMPVAPYWTSPEKMEKKLHAVPAAKTVKFKCPSSGTPNPTLR
WLKNGKEFKPDHRIGGYKVRYATWSIIMDSVVPSDKGNYTCIVENEY
GSINHTYQLDVVERSPHRPILQAGLPANKTVALGSNVEFMCKVYSDPQ
PHIQWLKHIEVNGSKIGPDNLPYVQILKTAGVNTTDKEMEVLHLRNVS
FEDAGEYTCLAGNSIGLSHHSAWLTVLEALEERPAVMTSPLYLEIIIYC
TGAFLISCMVGSVIVYKMKSGTKKSDFHSQMAVHKLAKSIPLRRQVT
VSADSSASMNSGVLLVRPSRLSSSGTPMLAGVSEYELPEDPRWELPRD
RLVLGKPLGEGCFGQVVLAEAIGLDKDKPNRVTKVAVKMLKSDATE
KDLSDLISEMEMMKMIGKHKNIINLLGACTQDGPLYVIVEYASKGNLR
EYLQARRPPGLEYCYNPSHNPEEQLSSKDLVSCAYQVARGMEYLASK
KCIHRDLAARNVLVTEDNVMKIADFGLARDIHHIDYYKKTTNGRLPV
KWMAPEALFDRIYTHQSDVWSFGVLLWEIFTLGGSPYPGVPVEELFKL
LKEGHRMDKPSNCTNELYMMMRDCWHAVPSQRPTFKQLVEDLDRIV
ALTSNQEYLDLSMPLDQYSPSFPDTRSSTCSSGEDSVFSHEPLPEEPCLP
RHPAQLANGGLKRR.

The antigen binding proteins described herein bind the extracellular portion of FGFR1c. An example of an extracellular region of FGFR1c is:

(SEQ ID NO: 5)
MWSWKCLLFWAVLVTATLCTARPSPTLPEQAQPWGAPVEVESFLVHP
GDLLQLRCRLRDDVQSINWLRDGVQLAESNRTRITGEEVEVQDSVPA
DSGLYACVTSSPSGSDTTYFSVNVSDALPSSEDDDDDDSSSEEKETD
NTKPNRMPVAPYWTSPEKMEKKLHAVPAAKTVKFKCPSSGTPNPTLR
WLKNGKEFKPDHRIGGYKVRYATWSIIMDSVVPSDKGNYTCIVENEY
GSINHTYQLDVVERSPHRPILQAGLPANKTVALGSNVEFMCKVYSDPQ
PHIQWLKHIEVNGSKIGPDNLPYVQILKTAGVNTTDKEMEVLHLRNVS
FEDAGEYTCLAGNSIGLSHHSAWLTVLEALEERPAVMTSPLY.

As described herein, FGFR1c proteins can also include fragments. As used herein, the terms are used interchangeably to mean a receptor, in particular and unless otherwise specified, a human receptor, that upon association with β-Klotho and FGF21 induces FGF21-like signaling activity.

The term FGFR1c also includes post-translational modifications of the FGFR1c amino acid sequence, for example, possible N-linked glycosylation sites. Thus, the antigen binding proteins can bind to or be generated from proteins glycosylated at one or more of the positions.

β-Klotho

The antigen binding proteins disclosed herein bind to β-Klotho, in particular human β-Klotho. The nucleotide sequence encoding human β-Klotho (GenBank Accession Number NM_175737) is provided:

(SEQ ID NO: 6)
ATGAAGCCAGGCTGTGCGGCAGGATCTCCAGGGAATGAATGGATT

TTCTTCAGCACTGATGAAATAACCACACGCTATAGGAATACAATGT

CCAACGGGGATTGCAAAGATCTGTCATCCTGTCAGCACTTATTCT

GCTACGAGCTGTTACTGGATTCTCTGGAGATGGAAGAGCTATATGG

TCTAAAAATCCTAATTTTACTCCGGTAAATGAAAGTCAGCTGTTTCT

CTATGACACTTTCCCTAAAAACTTTTTCTGGGGTATTGGGACTGGA

GCATTGCAAGTGGAAGGGAGTTGGAAGAAGGATGGAAAAGGACCT

TCTATATGGGATCATTTCATCCACACACACCTTAAAAATGTCAGCA

GCACGAATGGTTCCAGTGACAGTTATATTTTTCTGGAAAAAGACTT

ATCAGCCCTGGATTTTATAGGAGTTTCTTTTTATCAATTTTCAATTT

CCTGGCCAAGGCTTTTCCCCGATGGAATAGTAACAGTTGCCAACGC

AAAAGGTCTGCAGTACTACAGTACTCTTCTGGACGCTCTAGTGCTT

AGAAACATTGAACCTATAGTTACTTTATACCACTGGGATTTGCCTTT

GGCACTACAAGAAAAATATGGGGGGTGGAAAAATGATACCATAAT

AGATATCTTCAATGACTATGCCACATACTGTTTCCAGATGTTTGGG

GACCGTGTCAAATATTGGATTACAATTCACAACCCATATCTAGTGG

CTTGGCATGGGTATGGGACAGGTATGCATGCCCCTGGAGAGAAGG

GAAATTTAGCAGCTGTCTACACTGTGGGACACAACTTGATCAAGGC

TCACTCGAAAGTTTGGCATAACTACAACACACATTTCCGCCCACAT

CAGAAGGGTTGGTTATCGATCACGTTGGGATCTCATTGGATCGAGC

CAAACCGGTCGGAAAACACGATGGATATATTCAAATGTCAACAAT

CCATGGTTTCTGTGCTTGGATGGTTTGCCAACCCTATCCATGGGGAT

GGCGACTATCCAGAGGGGATGAGAAAGAAGTTGTTCTCCGTTCTAC

CCATTTTCTCTGAAGCAGAGAAGCATGAGATGAGAGGCACAGCTG

ATTTCTTTGCCTTTTCTTTTGGACCCAACAACTTCAAGCCCCTAAAC

ACCATGGCTAAAATGGGACAAAATGTTTCACTTAATTTAAGAGAAG

CGCTGAACTGGATTAAACTGGAATACAACAACCCTCGAATCTTGAT

TGCTGAGAATGGCTGGTTCACAGACAGTCGTGTGAAAACAGAAGA

CACCACGGCCATCTACATGATGAAGAATTTCCTCAGCCAGGTGCTT

CAAGCAATAAGGTTAGATGAAATACGAGTGTTTGGTTATACTGCCT

GGTCTCTCCTGGATGGCTTTGAATGGCAGGATGCTTACACCATCCG

CCGAGGATTATTTATGTGGATTTTAACAGTAAACAGAAAGAGCGG

AAACCTAAGTCTTCAGCACACTACTACAAACAGATCATACGAGAA

AATGGTTTTTCTTTAAAAGAGTCCACGCCAGATGTGCAGGGCCAGT

TTCCCTGTGACTTCTCCTGGGGTGTCACTGAATCTGTTCTTAAGCCC

GAGTCTGTGGCTTCGTCCCCACAGTTCAGCGATCCTCATCTGTACGT

GTGGAACGCCACTGGCAACAGACTGTTGCACCGAGTGGAAGGGGT

GAGGCTGAAAACACGACCCGCTCAATGCACAGATTTTGTAAACATC

AAAAAACAACTTGAGATGTTGGCAAGAATGAAAGTCACCCACTAC

CGGTTTGCTCTGGATTGGGCCTCGGTCCTTCCCACTGGCAACCTGTC

CGCGGTGAACCGACAGGCCCTGAGGTACTACAGGTGCGTGGTCAG

TGAGGGGCTGAAGCTTGGCATCTCCGCGATGGTCACCCTGTATTAT

CCGACCCACGCCCACCTAGGCCTCCCCGAGCCTCTGTTGCATGCCG

ACGGGTGGCTGAACCCATCGACGGCCGAGGCCTTCCAGGCCTACGC

TGGGCTGTGCTTCCAGGAGCTGGGGGACCTGGTGAAGCTCTGGATC

ACCATCAACGAGCCTAACCGGCTAAGTGACATCTACAACCGCTCTG

GCAACGACACCTACGGGGCGGCGCACAACCTGCTGGTGGCCCACG

CCCTGGCCTGGCGCCTCTACGACCGGCAGTTCAGGCCCTCACAGCG

CGGGGCCGTGTCGCTGTCGCTGCACGCGGACTGGGCGGAACCCGCC

AACCCCTATGCTGACTCGCACTGGAGGGCGGCCGAGCGCTTCCTGC

AGTTCGAGATCGCCTGGTTCGCCGAGCCGCTCTTCAAGACCGGGGA

CTACCCCGCGGCCATGAGGGAATACATTGCCTCCAAGCACCGACGG

GGGCTTTCCAGCTCGGCCCTGCCGCGCCTCACCGAGGCCGAAAGGA

GGCTGCTCAAGGGCACGGTCGACTTCTGCGCGCTCAACCACTTCAC

CACTAGGTTCGTGATGCACGAGCAGCTGGCCGGCAGCCGCTACGAC

TCGGACAGGGACATCCAGTTTCTGCAGGACATCACCCGCCTGAGCT

CCCCCACGCGCCTGGCTGTGATTCCCTGGGGGGTGCGCAAGCTGCT

GCGGTGGGTCCGGAGGAACTACGGCGACATGGACATTTACATCAC

CGCCAGTGGCATCGACGACCAGGCTCTGGAGGATGACCGGCTCCG

GAAGTACTACCTAGGGAAGTACCTTCAGGAGGTGCTGAAAGCATA

CCTGATTGATAAAGTCAGAATCAAAGGCTATTATGCATTCAAACTG

GCTGAAGAGAAATCTAAACCCAGATTTGGATTCTTCACATCTGATT

TTAAAGCTAAATCCTCAATACAATTTTACAACAAAGTGATCAGCAG

CAGGGGCTTCCCTTTTGAGAACAGTAGTTCTAGATGCAGTCAGACC

CAAGAAAATACAGAGTGCACTGTCTGCTTATTCCTTGTGCAGAAGA

AACCACTGATATTCCTGGGTTGTTGCTTCTTCTCCACCCTGGTTCTA

CTCTTATCAATTGCCATTTTTCAAAGGCAGAAGAGAAGAAAGTTTT

GGAAAGCAAAAAACTTACAACACATACCATTAAAGAAAGGCAAGA

GAGTTGTTAGCTAA.

The amino acid sequence of full length human β-Klotho (GenBank Accession Number NP_783864) is provided:

(SEQ ID NO: 7)
MKPGCAAGSPGNEWIFFSTDEITTRYRNTMSNGGLQRSVILSALILLRA

VTGFSGDGRAIWSKNPNFTPVNESQLFLYDTFPKNFFWGIGTGALQVE

GSWKKDGKGPSIWDHFIHTHLKNVSSTNGSSDSYIFLEKDLSALDFIGV

SFYQFSISWPRLFPDGIVTVANAKGLQYYSTLLDALVLRNIEPIVTLYH

-continued
```
WDLPLALQEKYGGWKNDTIIDIFNDYATYCFQMFGDRVKYWITIHNP

YLVAWHGYGTGMHAPGEKGNLAAVYTVGHNLIKAHSKVWHNYNTH

FRPHQKGWLSITLGSHWIEPNRSENTMDIFKCQQSMVSVLGWFANPIH

GDGDYPEGMRKKLFSVLPIFSEAEKHEMRGTADFFAFSFGPNNFKPLN

TMAKMGQNVSLNLREALNWIKLEYNNPRILIAENGWFTDSRVKTEDT

TAIYMMKNFLSQVLQAIRLDEIRVFGYTAWSLLDGFEWQDAYTIRRGL

FYVDFNSKQKERKPKSSAHYYKQIIRENGFSLKESTPDVQGQFPCDFS

WGVTESVLKPESVASSPQFSDPHLYVWNATGNRLLHRVEGVRLKTRP

AQCTDFVNIKKQLEMLARMKVTHYRFALDWASVLPTGNLSAVNRQA

LRYYRCVVSEGLKLGISAMVTLYYPTHAHLGLPEPLLHADGWLNPST

AEAFQAYAGLCFQELGDLVKLWITINEPNRLSDIYNRSGNDTYGAAHN

LLVAHALAWRLYDRQFRPSQRGAVSLSLHADWAEPANPYADSHWRA

AERFLQFEIAWFAEPLFKTGDYPAAMREYIASKHRRGLSSSALPRLTEA

ERRLLKGTVDFCALNHFTTRFVMHEQLAGSRYDSDRDIQFLQDITRLS

SPTRLAVIPWGVRKLLRWVRRNYGDMDIYITASGIDDQALEDDRLRK

YYLGKYLQEVLKAYLIDKVRIKGYYAFKLAEEKSKPRFGFFTSDFKAK

SSIQFYNKVISSRGFPFENSSSRCSQTQENTECTVCLFLVQKKPLIFLGC

CFFSTLVLLLSIAIFQRQKRRKFWKAKNLQHIPLKKGKRVVS.
```

The antigen binding proteins described herein bind the extracellular portion of β-Klotho. An example of an extracellular region of β-Klotho is:

```
                                         (SEQ ID NO: 8)
MKPGCAAGSPGNEWIFFSTDEITTRYRNTMSNGGLQRSVILSALILLRA

VTGFSGDGRAIWSKNPNFTPVNESQLFLYDTFPKNFFWGIGTGALQVE

GSWKKDGKGPSIWDHFIHTHLKNVSSTNGSSDSYIFLEKDLSALDFIGV

SFYQFSISWPRLFPDGIVTVANAKGLQYYSTLLDALVLRNIEPIVTLYH

WDLPLALQEKYGGWKNDTIIDIFNDYATYCFQMFGDRVKYWITIHNP

YLVAWHGYGTGMHAPGEKGNLAAVYTVGHNLIKAHSKVWHNYNTH

FRPHQKGWLSITLGSHWIEPNRSENTMDIFKCQQSMVSVLGWFANPIH

GDGDYPEGMRKKLFSVLPIFSEAEKHEMRGTADFFAFSFGPNNFKPLN

TMAKMGQNVSLNLREALNWIKLEYNNPRILIAENGWFTDSRVKTEDT

TAIYMMKNFLSQVLQAIRLDEIRVFGYTAWSLLDGFEWQDAYTIRRGL

FYVDFNSKQKERKPKSSAHYYKQIIRENGFSLKESTPDVQGQFPCDFS

WGVTESVLKPESVASSPQFSDPHLYVWNATGNRLLHRVEGVRLKTRP

AQCTDFVNIKKQLEMLARMKVTHYRFALDWASVLPTGNLSAVNRQA

LRYYRCVVSEGLKLGISAMVTLYYPTHAHLGLPEPLLHADGWLNPST

AEAFQAYAGLCFQELGDLVKLWITINEPNRLSDIYNRSGNDTYGAAHN

LLVAHALAWRLYDRQFRPSQRGAVSLSLHADWAEPANPYADSHWRA

AERFLQFEIAWFAEPLFKTGDYPAAMREYIASKHRRGLSSSALPRLTEA

ERRLLKGTVDFCALNHFTTRFVMHEQLAGSRYDSDRDIQFLQDITRLS

SPTRLAVIPWGVRKLLRWVRRNYGDMDIYITASGIDDQALEDDRLRK

YYLGKYLQEVLKAYLIDKVRIKGYYAFKLAEEKSKPRFGFFTSDFKAK

SSIQFYNKVISSRGFPFENSSSRCSQTQENTECTVCLFLVQKKP.
```

The murine form of β-Klotho, and fragments and subsequences thereof, can be of use in studying and/or constructing the molecules provided herein. The nucleotide sequence encoding murine β-Klotho (GenBank Accession Number NM_031180) is provided:

```
                                         (SEQ ID NO: 9)
ATGAAGACAGGCTGTGCAGCAGGGTCTCCGGGGAATGAATGGATT

TTCTTCAGCTCTGATGAAAGAAACACACGCTCTAGGAAAACAATGT

CCAACAGGGCACTGCAAAGATCTGCCGTGCTGTCTGCGTTTGTTCT

GCTGCGAGCTGTTACCGGCTTCTCCGGAGACGGGAAAGCAATATGG

GATAAAAAACAGTACGTGAGTCCGGTAAACCCAAGTCAGCTGTTCC

TCTATGACACTTTCCCTAAAAACTTTTCCTGGGGCGTTGGGACCGG

AGCATTTCAAGTGGAAGGGAGTTGGAAGACAGATGGAAGAGGACC

CTCGATCTGGGATCGGTACGTCTACTCACACCTGAGAGGTGTCAAC

GGCACAGACAGATCCACTGACAGTTACATCTTTCTGGAAAAAGACT

TGTTGGCTCTGGATTTTTTAGGAGTTTCTTTTTATCAGTTCTCAATCT

CCTGGCCACGGTTGTTTCCCAATGGAACAGTAGCAGCAGTGAATGC

GCAAGGTCTCCGGTACTACCGTGCACTTCTGGACTGCTGGTACTTT

AGGAATATCGAGCCCATTGTTACCTTGTACCATTGGGATTTGCCTCT

GACGCTCCAGGAAGAATATGGGGGCTGGAAAAATGCAACTATGAT

AGATCTCTTCAACGACTATGCCACATACTGCTTCCAGACCTTTGGA

GACCGTGTCAAATATTGGATTACAATTCACAACCCTTACCTTGTTGC

TTGGCATGGGTTTGGCACAGGTATGCATGCACCAGGAGAGAAGGG

AAATTTAACAGCTGTCTACACTGTGGGACACAACCTGATCAAGGCA

CATTCGAAAGTGTGGCATAACTACGACAAAAACTTCCGCCCTCATC

AGAAGGGTTGGCTCTCCATCACCTTGGGGTCCCATTGGATAGAGCC

AAACAGAACAGACAACATGGAGGACGTGATCAACTGCCAGCACTC

CATGTCCTCTGTGCTTGGATGGTTCGCCAACCCCATCCACGGGGAC

GGCGACTACCCTGAGTTCATGAAGACGGGCGCCATGATCCCCGAGT

TCTCTGAGGCAGAGAAGGAGGAGGTGAGGGGCACGGCTGATTTCT

TTGCCTTTTCCTTCGGGCCCAACAACTTCAGGCCCTCAAACACCGTG

GTGAAAATGGGACAAAATGTATCACTCAACTTAAGGCAGGTGCTG

AACTGGATTAAACTGGAATACGATGACCCTCAAATCTTGATTTCGG

AGAACGGCTGGTTCACAGATAGCTATATAAAGACAGAGGACACCA

CGGCCATCTACATGATGAAGAATTTCCTAAACCAGGTTCTTCAAGC

AATAAAATTTGATGAAATCCGCGTGTTTGGTTATACGGCCTGGACT

CTCCTGGATGCTTTGAGTGGCAGGATGCCTATACGACCCGACGAG

GGCTGTTTTATGTGGACTTTAACAGTGAGCAGAAAGAGAGGAAAC

CCAAGTCCTCGGCTCATTACTACAAGCAGATCATACAAGACAACGG

CTTCCCTTTGAAAGAGTCCACGCCAGACATGAAGGGTCGGTTCCCC
```

```
TGTGATTTCTCTTGGGGAGTCACTGAGTCTGTTCTTAAGCCCGAGTT

TACGGTCTCCTCCCCGCAGTTTACCGATCCTCACCTGTATGTGTGGA

ATGTCACTGGCAACAGATTGCTCTACCGAGTGGAAGGGGTAAGGCT

GAAAACAAGACCATCCCAGTGCACAGATTATGTGAGCATCAAAAA

ACGAGTTGAAATGTTGGCAAAAATGAAAGTCACCCACTACCAGTTT

GCTCTGGACTGGACCTCTATCCTTCCCACTGGCAATCTGTCCAAAGT

TAACAGACAAGTGTTAAGGTACTATAGGTGTGTGGTGAGCGAAGG

ACTGAAGCTGGGCGTCTTCCCCATGGTGACGTTGTACCACCCAACC

CACTCCCATCTCGGCCTCCCCCTGCCACTTCTGAGCAGTGGGGGGT

GGCTAAACATGAACACAGCCAAGGCCTTCCAGGACTACGCTGAGC

TGTGCTTCCGGGAGTTGGGGGACTTGGTGAAGCTCTGGATCACCAT

CAATGAGCCTAACAGGCTGAGTGACATGTACAACCGCACGAGTAA

TGACACCTACCGTGCAGCCCACAACCTGATGATCGCCCATGCCCAG

GTCTGGCACCTCTATGATAGGCAGTATAGGCCGGTCCAGCATGGGG

CTGTGTCGCTGTCCTTACATTGCGACTGGGCAGAACCTGCCAACCC

CTTTGTGGATTCACACTGGAAGGCAGCCGAGCGCTTCCTCCAGTTT

GAGATCGCCTGGTTTGCAGATCCGCTCTTCAAGACTGGCGACTATC

CATCGGTTATGAAGGAATACATCGCCTCCAAGAACCAGCGAGGGC

TGTCTAGCTCAGTCCTGCCGCGCTTCACCGCGAAGGAGAGCAGGCT

GGTGAAGGGTACCGTCGACTTCTACGCACTGAACCACTTCACTACG

AGGTTCGTGATACACAAGCAGCTGAACACCAACCGCTCAGTTGCAG

ACAGGGACGTCCAGTTCCTGCAGGACATCACCCGCCTAAGCTCGCC

CAGCCGCCTGGCTGTAACACCCTGGGGAGTGCGCAAGCTCCTTGCG

TGGATCCGGAGGAACTACAGAGACAGGGATATCTACATCACAGCC

AATGGCATCGATGACCTGGCTCTAGAGGATGATCAGATCCGAAAGT

ACTACTTGGAGAAGTATGTCCAGGAGGCTCTGAAAGCATATCTCAT

TGACAAGGTCAAAATCAAAGGCTACTATGCATTCAAACTGACTGAA

GAGAAATCTAAGCCTAGATTTGGATTTTTCACCTCTGACTTCAGAG

CTAAGTCCTCTGTCCAGTTTTACAGCAAGCTGATCAGCAGCAGTGG

CCTCCCCGCTGAGAACAGAAGTCCTGCGTGTGGTCAGCCTGCGGAA

GACACAGACTGCACCATTTGCTCATTTCTCGTGGAGAAGAAACCAC

TCATCTTCTTCGGTTGCTGCTTCATCTCCACTCTGGCTGTACTGCTAT

CCATCACCGTTTTTCATCATCAAAAGAGAAGAAAATTCCAGAAAGC

AAGGAACTTACAAAATATACCATTGAAGAAAGGCCACAGCAGAGT

TTTCAGCTAA.
```

The amino acid sequence of full length murine β-Klotho (GenBank Accession Number NP_112457) is provided:

```
                                        (SEQ ID NO: 10)
MKTGCAAGSPGNEWIFFSSDERNTRSRKTMSNRALQRSAVLSAFVLLR

AVTGFSGDGKAIWDKKQYVSPVNPSQLFLYDTFPKNFSWGVGTGAFQ

VEGSWKTDGRGPSIWDRYVYSHLRGVNGTDRSTDSYIFLEKDLLALD

FLGVSFYQFSISWPRLFPNGTVAAVNAQGLRYYRALLDSLVLRNIEPIV

TLYHWDLPLTLQEEYGGWKNATMIDLFNDYATYCFQTFGDRVKYWI

TIHNPYLVAWHGFGTGMHAPGEKGNLTAVYTVGHNLIKAHSKVWHN

YDKNFRPHQKGWLSITLGSHWIEPNRTDNMEDVINCQHSMSSVLGWF

ANPIHGDGDYPEFMKTGAMIPEFSEAEKEEVRGTADFFAFSFGPNNFRP

SNTVVKMGQNVSLNLRQVLNWIKLEYDDPQILISENGWFTDSYIKTED

TTAIYMMKNFLNQVLQAIKFDEIRVFGYTAWTLLDGFEWQDAYTTRR

GLFYVDFNSEQKERKPKSSAHYYKQIIQDNGFPLKESTPDMKGRFPCD

FSWGVTESVLKPEFTVSSPQFTDPHLYVWNVTGNRLLYRVEGVRLKT

RPSQCTDYVSIKKRVEMLAKMKVTHYQFALDWTSILPTGNLSKVNRQ

VLRYYRCVVSEGLKLGVFPMVTLYHPTHSHLGLPLPLLSSGGWLNMN

TAKAFQDYAELCFRELGDLVKLWITINEPNRLSDMYNRTSNDTYRAA

HNLMIAHAQVWHLYDRQYRPVQHGAVSLSLHCDWAEPANPFVDSH

WKAAERFLQFEIAWFADPLFKTGDYPSVMKEYIASKNQRGLSSSVLPR

FTAKESRLVKGTVDFYALNHFTTRFVIHKQLNTNRSVADRDVQFLQDI

TRLSSPSRLAVTPWGVRKLLAWIRRNYRDRDIYITANGIDDLALEDDQI

RKYYLEKYVQEALKAYLIDKVKIKGYYAFKLTEEKSKPRFGFFTSDFR

AKSSVQFYSKLISSSGLPAENRSPACGQPAEDTDCTICSFLVEKKPLIFF

GCCFISTLAVLLSITVFHHQKRRKFQKARNLQNIPLKKGHSRVFS.
```

As described herein, β-Klotho proteins can also include fragments. As used herein, the terms are used interchangeably to mean a co-receptor, in particular and unless otherwise specified, a human co-receptor, that upon association with FGFR1c and FGF21 induces FGF21-like signaling activity.

The term β-Klotho also includes post-translational modifications of the β-Klotho amino acid sequence, for example, possible N-linked glycosylation sites. Thus, the antigen binding proteins can bind to or be generated from proteins glycosylated at one or more of the positions.

Antigen Binding Proteins that Specifically Bind to a Complex Comprising β-Klotho and an FGFR (e.g., FGFR1c, FGFR2c or FGFR3c)

A variety of selective binding agents useful for modulating FGF21-like signaling are provided. These agents include, for instance, antigen binding proteins that contain an antigen binding domain (e.g., single chain antibodies, domain antibodies, hemibodies, immunoadhesions, and polypeptides with an antigen binding region) and specifically bind to a complex comprising β-Klotho and at least one of (i) FGFR1c, (ii) FGFR2c and (iii) FGFR3c, in particular a complex comprising human β-Klotho and a human FGFR (e.g., human FGFR1c, human FGFR2c or human FGFR3c). Some of the agents, for example, are useful in mimicking the signaling effect generated in vivo by the association of an FGFR (e.g., FGFR1c, FGFR2c or FGFR3c) with β-Klotho and with FGF21, and can thus be used to enhance or modulate one or more activities associated with FGF21-like signaling.

In general, the antigen binding proteins that are provided typically comprise one or more CDRs as described herein (e.g., 1, 2, 3, 4, 5 or 6 CDRs). In some embodiments the antigen binding proteins are naturally expressed by clones, while in other embodiments, the antigen binding protein can comprise (a) a polypeptide framework structure and (b) one or more CDRs that are inserted into and/or joined to the polypeptide framework structure. In some of these embodiments a CDR forms a component of a heavy or light chains expressed by the clones described herein; in other embodiments a CDR can be inserted into a framework in which the CDR is not naturally expressed. A polypeptide framework structure can take a variety of different forms. For example, a polypeptide framework structure can be, or comprise, the framework of a naturally occurring antibody, or fragment or variant thereof, or it can be completely synthetic in nature. Examples of various antigen binding protein structures are further described below.

In some embodiments in which the antigen binding protein comprises (a) a polypeptide framework structure and (b) one or more CDRs that are inserted into and/or joined to the polypeptide framework structure, the polypeptide framework structure of an antigen binding protein is an antibody or is derived from an antibody, including, but not limited to, monoclonal antibodies, bispecific antibodies, minibodies, domain antibodies, synthetic antibodies (sometimes referred to herein as "antibody mimetics"), chimeric antibodies, humanized antibodies, antibody fusions (sometimes referred to as "antibody conjugates"), and portions or fragments of each, respectively. In some instances, the antigen binding protein is an immunological fragment of an antibody (e.g., a Fab, a Fab', a F(ab')$_2$, or a scFv).

Certain of the antigen binding proteins as provided herein specifically bind to a complex comprising β-Klotho and at least one of (i) FGFR1c, (ii) FGFR2c and (iii) FGFR3c, including the human forms of these proteins. In one embodiment, an antigen binding protein specifically binds to both human FGFR1c comprising the amino acid sequence of SEQ ID NO: 4, and human β-Klotho comprising the amino acid sequence of SEQ ID NO: 7, and in another embodiment an antigen binding protein specifically binds to both human FGFR1c comprising the amino acid sequence of SEQ ID NO: 4 and human β-Klotho having the amino acid sequence of SEQ ID NO: 7 and induces FGF21-like signaling. Thus, an antigen binding protein can, but need not, induce FGF21-like signaling.

Antigen Binding Protein Structure

Some of the antigen binding proteins that specifically bind to a complex comprising β-Klotho and at least one of (i) FGFR1c, (ii) FGFR2c and (iii) FGFR3c, including the human forms of these proteins, provided herein have a structure typically associated with naturally occurring antibodies. The structural units of these antibodies typically comprise one or more tetramers, each composed of two identical couplets of polypeptide chains, though some species of mammals also produce antibodies having only a single heavy chain. In a typical antibody, each pair or couplet includes one full-length "light" chain (in certain embodiments, about 25 kDa) and one full-length "heavy" chain (in certain embodiments, about 50-70 kDa).

Each individual immunoglobulin chain is composed of several "immunoglobulin domains," each consisting of roughly 90 to 110 amino acids and expressing a characteristic folding pattern. These domains are the basic units of which antibody polypeptides are composed. The amino-terminal portion of each chain typically includes a variable domain that is responsible for antigen recognition. The carboxy-terminal portion is more conserved evolutionarily than the other end of the chain and is referred to as the "constant region" or "C region". Human light chains generally are classified as kappa ("κ") and lambda ("λ") light chains, and each of these contains one variable domain and one constant domain. Heavy chains are typically classified as mu, delta, gamma, alpha, or epsilon chains, and these define the antibody's isotype as IgM, IgD, IgG, IgA, and IgE, respectively. IgG has several subtypes, including, but not limited to, IgG1, IgG2, IgG3, and IgG4. IgM subtypes include IgM, and IgM2. IgA subtypes include IgA1 and IgA2. In humans, the IgA and IgD isotypes contain four heavy chains and four light chains; the IgG and IgE isotypes contain two heavy chains and two light chains; and the IgM isotype contains five heavy chains and five light chains. The heavy chain C region typically comprises one or more domains that can be responsible for effector function. The number of heavy chain constant region domains will depend on the isotype. IgG heavy chains, for example, each contain three C region domains known as $C_H1$, $C_H2$ and $C_H3$. The antibodies that are provided can have any of these isotypes and subtypes. In certain embodiments, an antigen binding protein that specifically binds to a complex comprising β-Klotho and at least one of (i) FGFR1c, (ii) FGFR2c and (iii) FGFR3c is an antibody of the IgG1, IgG2, or IgG4 subtype.

In full-length light and heavy chains, the variable and constant regions are joined by a "J" region of about twelve or more amino acids, with the heavy chain also including a "D" region of about ten more amino acids. See, e.g., *Fundamental Immunology*, 2nd ed., Ch. 7 (Paul, W., ed.) 1989, New York: Raven Press (hereby incorporated by reference in its entirety for all purposes). The variable regions of each light/heavy chain pair typically form the antigen binding site.

One example of an IgG2 heavy constant domain of an exemplary monoclonal antibody that specifically binds to a complex comprising β-Klotho and at least one of (i) FGFR1c, (ii) FGFR2c and (iii) FGFR3c has the amino acid sequence:

(SEQ ID NO: 11)
ASTKGPSVFPLAPCSRSTSESTAALGCLVKDYFPEPVTVSWNSGALTSG

VHTFPAVLQSSGLYSLSSVVTVPSSNFGTQTYTCNVDHKPSNTKVDKT

VERKCCVECPPCPAPPVAGPSVFLFPPKPKDTLMISRTPEVTCVVVDVS

HEDPEVQFNWYVDGVEVHNAKTKPREEQFNSTFRVVSVLTVVHQDW

LNGKEYKCKVSNKGLPAPIEKTISKTKGQPREPQVYTLPPSREEMTKN

QVSLTCLVKGFYPSDIAVEWESNGQPENNYKTTPPMLDSDGSFFLYSK

LTVDKSRWQQGNVFSCSVMHEALHNHYTQKSLSLSPGK.

One example of a kappa light constant domain of an exemplary monoclonal antibody that binds to a complex comprising β-Klotho and at least one of (i) FGFR1c, (ii) FGFR2c and (iii) FGFR3c has the amino acid sequence:

(SEQ ID NO: 12)
TVAAPSVFIFPPSDEQLKSGTASVVCLLNNFYPREAKVQWKVDNALQS

GNSQESVTEQDSKDSTYSLSSTLTLSKADYEKHKVYACEVTHQGLSSP

VTKSFNRGEC.

One example of a lambda light constant domain of an exemplary monoclonal antibody that binds to a complex comprising β-Klotho and at least one of (i) FGFR1c, (ii) FGFR2c and (iii) FGFR3c has the amino acid sequence:

(SEQ ID NO: 13)
QPKANPTVTLFPPSSEELQANKATLVCLISDFYPGAVTVAWKADGSPV

KAGVETTKPSKQSNNKYAASSYLSLTPEQWKSHRSYSCQVTHEGSTV

EKTVAPTECS.

Variable regions of immunoglobulin chains generally exhibit the same overall structure, comprising relatively conserved framework regions (FR) joined by three hypervariable regions, more often called "complementarity determining regions" or CDRs. The CDRs from the two chains of each heavy chain/light chain pair mentioned above typically are aligned by the framework regions to form a structure that binds specifically with a specific epitope on the target protein (e.g., a complex comprising β-Klotho and at least one of (i) FGFR1c, (ii) FGFR2c and (iii) FGFR3c. From N-terminal to C-terminal, naturally-occurring light and heavy chain variable regions both typically conform with the following order of these elements: FR1, CDR1, FR2, CDR2, FR3, CDR3 and FR4. A numbering system has been devised for assigning numbers to amino acids that occupy positions in each of these domains. This numbering system is defined in Kabat et al., (1991) "Sequences of Proteins of Immunological Interest", 5th Ed., US Dept. of Health and Human Services, PHS, NIH, NIH Publication no. 91-3242. Although presented using the Kabat nomenclature system, as desired, the CDRs disclosed herein can also be redefined according an alternative nomenclature scheme, such as that of Chothia (see Chothia & Lesk, (1987) *J. Mol. Biol.* 196:901-917; Chothia et al., (1989) *Nature* 342:878-883 or Honegger & Pluckthun, (2001) *J. Mol. Biol.* 309:657-670).

The various heavy chain and light chain variable regions of antigen binding proteins provided herein are depicted in Table 2. Each of these variable regions can be attached to the disclosed heavy and light chain constant regions to form a complete antibody heavy and light chain, respectively. Further, each of the so-generated heavy and light chain sequences can be combined to form a complete antibody structure. It should be understood that the heavy chain and light chain variable regions provided herein can also be attached to other constant domains having different sequences than the exemplary sequences listed above.

Specific examples of some of the full length light and heavy chains of the antibodies that are provided and their corresponding amino acid sequences are summarized in Tables 1A and 1B. Table 1A shows exemplary light chain sequences, and Table 1B shows exemplary heavy chain sequences.

TABLE 1A

Exemplary Antibody Light Chain Sequences

| Contained in Clone | Designation | SEQ ID NO: | Amino Acid Sequence |
|---|---|---|---|
| 63E6 | L6 | 14 | DIQMTQSPSSLSASVGDRVTITCRTSQSISSYL NWYQQKPGKAPNLLIYAASSLQSGVPSRFSG SGSGTDFTLTISGLQPEDFSTYYCQQSYSTSL TFGGGTKVEIKRTVAAPSVFIFPPSDEQLKSG TASVVCLLNNFYPREAKVQWKVDNALQSG NSQESVTEQDSKDSTYSLSSTLTLSKADYEK HKVYACEVTHQGLSSPVTKSFNRGEC |
| 66F7 | L7 | 15 | DIQMTQSPSSLSASVGDRVTITCRTSQSISNY LNWYQQKPGKAPNLLIYAASSLQSGVPSRFS GSGSGTDFTLTISGLQPEDFSTYYCQQSYSTS LTFGGGTKVEIKRTVAAPSVFIFPPSDEQLKS GTASVVCLLNNFYPREAKVQWKVDNALQS GNSQESVTEQDSKDSTYSLSSTLTLSKADYE KHKVYACEVTHQGLSSPVTKSFNRGEC |
| 66D4 | L18 | 16 | DIQMTQSPSSLSASVGDRITITCRASQIISRYL NWYQQNPGKAPKLLISAASSLQSGVPSRFSG SGSGPDFTLTISSLQPEDFTTYYCQQSYSSPLT FGGGTKVEVKRTVAAPSVFIFPPSDEQLKSG TASVVCLLNNFYPREAKVQWKVDNALQSG NSQESVTEQDSKDSTYSLSSTLTLSKADYEK HKVYACEVTHQGLSSPVTKSFNRGEC |
| 66B4 | L11 | 17 | DIQMTQSPSSVSSSVGDRVTITCRASQGISRW LAWYQQKPGKAPKLLIYAASSLKSGVPSRFS GSGSGTDFTLTISSLQPEDFATYYCQQANSFP PTFGQGTKVEIKRTVAAPSVFIFPPSDEQLKS GTASVVCLLNNFYPREAKVQWKVDNALQS GNSQESVTEQDSKDSTYSLSSTLTLSKADYE KHKVYACEVTHQGLSSPVTKSFNRGEC |
| 65B1 | L19 | 18 | DIQMTQSPSSLSASVGDRVTITCRASQNINNY LNWYRQKPGKAPELLIYTTSSLQSGVPSRFS GSGSGTDFTLTISSLETEDFETYYCQQSYSTP LTFGGGTKVEIKRTVAAPSVFIFPPSDEQLKS GTASVVCLLNNFYPREAKVQWKVDNALQS GNSQESVTEQDSKDSTYSLSSTLTLSKADYE KHKVYACEVTHQGLSSPVTKSFNRGEC |
| 65B4 | L21 | 19 | SYVLTQPPSVSVAPGQTARITCGGNNIGSKSV QWYQQKPGQAPVLVVYDDSDRPSGIPERFS GSNSGNTASLTISRVEAGDEADYYCQVWDS |

TABLE 1A-continued

Exemplary Antibody Light Chain Sequences

| Contained in Clone | Designation | SEQ ID NO: | Amino Acid Sequence |
|---|---|---|---|
| | | | SSDHVVFGGGTKLTVLGQPKANPTVTLFPPS<br>SEELQANKATLVCLISDFYPGAVTVAWKAD<br>GSPVKAGVETTKPSKQSNNKYAASSYLSLTP<br>EQWKSHRSYSCQVTHEGSTVEKTVAPTECS |
| 67A4 | L20 | 20 | SYVLTQPPSVSVAPGQTARITCGGNNIGSKSV<br>HWYQQKPGQAPVLVVYDDSDRPSGIPERFS<br>GSNSGNTATLTISRVEAGDEADYYCQVWDS<br>SSDHVVFGGGTKLTVLGQPKANPTVTLFPPS<br>SEELQANKATLVCLISDFYPGAVTVAWKAD<br>GSPVKAGVETTKPSKQSNNKYAASSYLSLTP<br>EQWKSHRSYSCQVTHEGSTVEKTVAPTECS |
| 63A10v1 | L22 | 21 | SYELTQPHSVSVATAQMARITCGGNNIGSKA<br>VHWYQQKPGQDPVLVIYCDSNRPSGIPER<br>FSGSNPGNTATLTISRIEAGDEADYYCQVWD<br>SSSDGVFGGGTKLTVLGQPKANPTVTLFPPS<br>SEELQANKATLVCLISDFYPGAVTVAWKAD<br>GSPVKAGVETTKPSKQSNNKYAASSYLSLTP<br>EQWKSHRSYSCQVTHEGSTVEKTVAPTECS |
| 63A10v2 | L101 | 1835 | SYELTQPHSVSVATAQMARITCGGNNIGSKA<br>VHWYQQKPGQDPVLVIYCDSNRPSGIPER<br>FSGSNPGNTATLTISRIEAGDEADYYCQAWD<br>STTVVFGGGTKLTVLGQPKANPTVTLFPPSS<br>EELQANKATLVCLISDFYPGAVTVAWKADG<br>SPVKAGVETTKPSKQSNNKYAASSYLSLTPE<br>QWKSHRSYSCQVTHEGSTVEKTVAPTECS |
| 63A10v3 | L102 | 1836 | SYELTQPPSVSVSPGQTANITCSGDKLGNRY<br>TCWYQQKSGQSPVLVIYQDSERPSGIPER<br>FSGSNSGNTATLTISGTQAMDEADYYCQAW<br>DSTTVVFGGGTKLTVLGQPKANPTVTLFPPS<br>SEELQANKATLVCLISDFYPGAVTVAWKAD<br>GSPVKAGVETTKPSKQSNNKYAASSYLSLTP<br>EQWKSHRSYSCQVTHEGSTVEKTVAPTECS |
| 65H11v1 | L23 | 22 | SYELTQPHSVSVATAQMARITCGGNNIGSKT<br>VHWFQQKPGQDPVLVIYSDSNRPSGIPERFS<br>GSNPGNTATLTISRIEAGDEADYYCQVWDSS<br>CDGVFGGGTKLTVLGQPKANPTVTLFPPSSE<br>ELQANKATLVCLISDFYPGAVTVAWKADGS<br>PVKAGVETTKPSKQSNNKYAASSYLSLTPEQ<br>WKSHRSYSCQVTHEGSTVEKTVAPTECS |
| 65H11v2 | L103 | 1837 | SYELTQPPSVSVSPGQTANITCSGDKLGDRY<br>VCWYQQKPGQSPVLVIYQDSKRPSGIPEQFS<br>GSNSGNTATLTISGTQAIDEADYYCQAWDSI<br>TVVFGGGTKLTVLGQPKANPTVTLFPPSSEE<br>LQANKATLVCLISDFYPGAVTVAWKADGSP<br>VKAGVETTKPSKQSNNKYAASSYLSLTPEQ<br>WKSHRSYSCQVTHEGSTVEKTVAPTECS |
| 67G10v1 | L9 | 23 | SYELTQPHSVSVATAQMARITCGGNNIGSKA<br>VHWYQQKPGQDPVLVIYSDSNRPSGIPERFS<br>GSNPGNTATLTISRIEAGDEADYYCQVWDSS<br>SDGVFGGGTKLTVLGQPKANPTVTLFPPSSE<br>ELQANKATLVCLISDFYPGAVTVAWKADGS<br>PVKAGVETTKPSKQSNNKYAASSYLSLTPEQ<br>WKSHRSYSCQVTHEGSTVEKTVAPTECS |
| 67G10v2 | L10 | 24 | SYELTQPPSVSVSPGQTASITCSGDKLGDKY<br>ACWYQQKPGQSPVLVIYQDNERPSGIPERFS<br>GSNSGNTATLTISGTQAMDEADYYCQAWDS<br>TTVVFGGGTKLTVLGQPKANPTVTLFPPSSE<br>ELQANKATLVCLISDFYPGAVTVAWKADGS<br>PVKAGVETTKPSKQSNNKYAASSYLSLTPEQ<br>WKSHRSYSCQVTHEGSTVEKTVAPTECS |
| 64C8 | L24 | 25 | DVVMTQSPLSLPVTLGQPASISRRSSPSLVYS<br>DGNTYLNCFQQRPGHSPRRLIYKGSNWDSG<br>VPDRFSGSGSGTDFTLKISRVEAEDVGIYYCI<br>QDTHWPTCSFGQGTKLEIKRTVAAPSVFIFPP<br>SDEQLKSGTASVVCLLNNFYPREAKVQWKV<br>DNALQSGNSQESVTEQDSKDSTYSLSSTLTL |

TABLE 1A-continued

Exemplary Antibody Light Chain Sequences

| Contained in Clone | Designation | SEQ ID NO: | Amino Acid Sequence |
|---|---|---|---|
| | | | SKADYEKHKVYACEVTHQGLSSPVTKSFNR GEC |
| 64A8 67B4 | L1 | 26 | DIQMTQSPSSLSASVGDRVTITCRASQDIRND LGWYQQKPGKAPKRLIYAASNLQRGVPSRF SGSGSGTEFTLTISTLQPEDFATYSCLQHNSY PLTFGGGTKVEIKRTVAAPSVFIFPPSDEQLK SGTASVVCLLNNFYPREAKVQWKVDNALQS GNSQESVTEQDSKDSTYSLSSTLTLSKADYE KHKVYACEVTHQGLSSPVTKSFNRGEC |
| 63G8v1 | L104 | 1838 | DIQMTQSPSSLSASVGDRVTITCRASQDIRND LGWYQQKPGKAPKRLIYAASNLQRGVPSRF SGSGSGTEFTLTISTLQPDDFATYSCLQHNSY PLTFGGGTKVEIKRTVAAPSVFIFPPSDEQLK SGTASVVCLLNNFYPREAKVQWKVDNALQS GNSQESVTEQDSKDSTYSLSSTLTLSKADYE KHKVYACEVTHQGLSSPVTKSFNRGEC |
| 63G8v2 | L105 | 1839 | DIQMTQSPSSLSASVGDRVTITCRASQGIRSG LGWYQQKPGKAPKRLIYAASNLQRGVPSRF SGSGSGTEFTLTVSSLQPEDFATYSCLQHNSY PLTFGGGTKVEIKRTVAAPSVFIFPPSDEQLK SGTASVVCLLNNFYPREAKVQWKVDNALQS GNSQESVTEQDSKDSTYSLSSTLTLSKADYE KHKVYACEVTHQGLSSPVTKSFNRGEC |
| 63G8v3 | L106 | 1840 | DIQMTQSPSSLSASVGDRVTITCRASQGIRSG LGWYQQKPGKAPKRLIYAASNLQRGVPSRF SGSGSGTEFTLTVSSLQPEDFATYSCLQHNTY PLTFGGGTKGEIRRTVAAPSVFIFPPSDEQLK SGTASVVCLLNNFYPREAKVQWKVDNALQS GNSQESVTEQDSKDSTYSLSSTLTLSKADYE KHKVYACEVTHQGLSSPVTKSFNRGEC |
| 66G2 | L12 | 27 | DIQMTQSPSSLSASVGDRVTITCRASQGIRND LGWYQQKPGKAPKRLIYAASNLQSGVPSRFS GSGSGTKFTLTINSLQPEDFATYYCLQLNGY PLTFGGGTKVEIKRTVAAPSVFIFPPSDEQLK SGTASVVCLLNNFYPREAKVQWKVDNALQS GNSQESVTEQDSKDSTYSLSSTLTLSKADYE KHKVYACEVTHQGLSSPVTKSFNRGEC |
| 68D3v1 68D3v2 | L2 | 28 | DIQMTQSPSSLSASVGDRVTITCRASQDIRND LGWYQQKPGKAPKRLIYAASNLQRGVPSRF SGSGSGTEFTLTISTLQPDDFATYSCLQHNSY PLTFGGGTKVEIKRTVAAPSVFIFPPSDEQLK SGTASVVCLLNNFYPREAKVQWKVDNALQS GNSQESVTEQDSKDSTYSLSSTLTLSKADYE KHKVYACEVTHQGLSSPVTKSFNRGEC |
| 65D1 | L27 | 29 | SYDLTQPPSVSVSPGQTASITCSGDKLGDKY VCWYQQKPGQSPVLVIYQDSKRPSGIPERFS GSNSGNTATLTISGIQAMDEADYYCQAWDS RVFGGGTKLTVLGQPKANPTVTLFPPSSEEL QANKATLVCLISDFYPGAVTVAWKADGSPV KAGVETTKPSKQSNNKYAASSYLSLTPEQW KSHRSYSCQVTHEGSTVEKTVAPTECS |
| 64H5 65G4 | L8 | 30 | SYEMTQPLSVSVALGQTARITCGGNNIGSKN VHWYQQKPGQAPVLVIYRDSKRPSGIPERFS GSNSGNTATLTISRAQAGDEADYYCQVWDS SSVVFGGGTKLTVLGQPKANPTVTLFPPSSEE LQANKATLVCLISDFYPGAVTVAWKADGSP VKAGVETTKPSKQSNNKYAASSYLSLTPEQ WKSHRSYSCQVTHEGSTVEKTVAPTECS |
| 65D4 | L26 | 31 | SYELTQPLSVSVALGQTARIPCGGNDIGSKN VHWYQQKPGQAPVLVIYRDRNRPSGIPERFS GSNSGNTATLTISRAQAGDEADYYCQVWDS NPVVFGGGTKLTVLGQPKANPTVTLFPPSSE ELQANKATLVCLISDFYPGAVTVAWKADGS PVKAGVETTKPSKQSNNKYAASSYLSLTPEQ WKSHRSYSCQVTHEGSTVEKTVAPTECS |

TABLE 1A-continued

Exemplary Antibody Light Chain Sequences

| Contained in Clone | Designation | SEQ ID NO: | Amino Acid Sequence |
|---|---|---|---|
| 65E3 | L25 | 32 | SYELTQPLSVSVALGQTARITCGGNNIGSKN VHWYQQKPGQAPVLVIYRDRNRPSGIPERFS GSNSGNTATLTISRAQAGDEADYYCQVWDS STVVFGGGTKLTVLGQPKANPTVTLFPPSSE ELQANKATLVCLISDFYPGAVTVAWKADGS PVKAGVETTKPSKQSNNKYAASSYLSLTPEQ WKSHRSYSCQVTHEGSTVEKTVAPTECS |
| 67G8 | L28 | 33 | SYELTQPLSVSVALGQTARITCGGNNIGSYN VFWYQQKPGQAPVLVIYRDSKRPSGIPERFS GSNSGNTATLTISRAQAGDEADYHCQVWDS STVVFGGGTKLTVLGQPKANPTVTLFPPSSE ELQANKATLVCLISDFYPGAVTVAWKADGS PVKAGVETTKPSKQSNNKYAASSYLSLTPEQ WKSHRSYSCQVTHEGSTVEKTVAPTECS |
| 65B7v1 | L29 | 34 | EIVLTQSPGTLSLSPGERATLSCRASQSVSSIY LAWYQQKPGQAPRLLIYGASSRATGIPDRFS GSGSGTDFTLTISRLEPEDFAVYYCQQYGSSC SFGQGTKLEIKRTVAAPSVFIFPPSDEQLKSG TASVVCLLNNFYPREAKVQWKVDNALQSG NSQESVTEQDSKDSTYSLSSTLTLSKADYEK HKVYACEVTHQGLSSPVTKSFNRGEC |
| 65B7v2 | L107 | 1841 | DVVMTQSPLSLPVTLGQPASISYRSSQSLVYS DGDTYLNWFQQRPGQSPRRLIYKVSNWDSG VPDRFSGSGSGTDFTLKISRVEAEDVGVYYC MQGTHWRGWTFGQGTKVEIKRTVAAPSVFI FPPSDEQLKSGTASVVCLLNNFYPREAKVQ WKVDNALQSGNSQESVTEQDSKDSTYSLSS TLTLSKADYEKHKVYACEVTHQGLSSPVTK SFNRGEC |
| 63B6 64D4 | L4 | 35 | EIVLTQSPGTLSLSPGERATLSCRASQSVSNS YLAWYQQKPGQAPRLLIYGAFSRATGIPDRF SGSGSGTDFTLTISRLEPEDFAVYYCQQFGRS FTFGGGTKVEIRRTVAAPSVFIFPPSDEQLKS GTASVVCLLNNFYPREAKVQWKVDNALQS GNSQESVTEQDSKDSTYSLSSTLTLSKADYE KHKVYACEVTHQGLSSPVTKSFNRGEC |
| 63F5 | L14 | 36 | EVVLTQSPGTLSLSPGERATLSCRASQTVRN NYLAWYQQQPGQAPRLLIFGASSRATGIPDR FSGSGSGTDFTLTISRLEPEDFAVYYCQQFGS SLTFGGGTKVEIKRTVAAPSVFIFPPSDEQLK SGTASVVCLLNNFYPREAKVQWKVDNALQS GNSQESVTEQDSKDSTYSLSSTLTLSKADYE KHKVYACEVTHQGLSSPVTKSFNRGEC |
| 65E8 63H11 64E6 67G7 65F11 | L3 | 37 | EIVLTQSPGTLSLSPGERATLSCRASQSVRNS YLAWYQQQPGQAPRLLIYGAFSRASGIPDRF SGSGSGTDFTLTISRLEPEDFAVYYCQQFGSS LTFGGGTKVEIKRTVAAPSVFIFPPSDEQLKS GTASVVCLLNNFYPREAKVQWKVDNALQS GNSQESVTEQDSKDSTYSLSSTLTLSKADYE KHKVYACEVTHQGLSSPVTKSFNRGEC |
| 65C1 | L16 | 38 | EIVLTQSPGTLSLSPGERATLSCRASQTIRNSY LAWYQQQPGQAPRLLIYGAFSRATGIPDRFS GGGSGTDFTLTISRLEPEDFAVYYCQQFGSSL TFGGGTKVEIKRTVAAPSVFIFPPSDEQLKSG TASVVCLLNNFYPREAKVQWKVDNALQSG NSQESVTEQDSKDSTYSLSSTLTLSKADYEK HKVYACEVTHQGLSSPVTKSFNRGEC |
| 66F6 | L15 | 39 | EIVLTQSPGTLSLSPGERATLSCRASQSVRNS YLAWYQQQPGQAPRLLIYGAFSRATGIPDRF SGSGSGTDFTLTISRLEPEDFAVYYCQQFGSS LTFGGGTKVEIKRTVAAPSVFIFPPSDEQLKS GTASVVCLLNNFYPREAKVQWKVDNALQS GNSQESVTEQDSKDSTYSLSSTLTLSKADYE KHKVYACEVTHQGLSSPVTKSFNRGEC |
| 64A6 | L30 | 40 | EILMTQSPATLSVSPGERATLSCRASQSVNSN LAWYQQKPGQAPRLLIYGTSTRATGVPARF |

TABLE 1A-continued

Exemplary Antibody Light Chain Sequences

| Contained in Clone | Designation | SEQ ID NO: | Amino Acid Sequence |
|---|---|---|---|
| | | | GGSGSGTEFTLTISSLQSEDFAFYYCQQYNT WPWTFGQGTKVEIKRTVAAPSVFIFPPSDEQ LKSGTASVVCLLNNFYPREAKVQWKVDNAL QSGNSQESVTEQDSKDSTYSLSSTLTLSKAD YEKHKVYACEVTHQGLSSPVTKSFNRGEC |
| 65F9 | L31 | 41 | EILMTQSPATLSVSPGERATLSCRASQSVSSN LAWYQQKPGQSPRLLIYGASTRATGIPARFG GSGSGTDFTLTISSLQSEDFAFYYCQQYNTW PWTFGQGTKVEIKRTVAAPSVFIFPPSDEQLK SGTASVVCLLNNFYPREAKVQWKVDNALQS GNSQESVTEQDSKDSTYSLSSTLTLSKADYE KHKVYACEVTHQGLSSPVTKSFNRGEC |
| 64A7 | L17 | 42 | EIVLTQSPGTLSLSPGERATLSCRASQSVSRN YLAWYQQKPGQAPRLLIYGASSRATGVPDR FSGSGSGTDFTLTISRLEPEDFAVYYCQQYGS SSLCSFGQGTNLDIRRTVAAPSVFIFPPSDEQL KSGTASVVCLLNNFYPREAKVQWKVDNAL QSGNSQESVTEQDSKDSTYSLSSTLTLSKAD YEKHKVYACEVTHQGLSSPVTKSFNRGEC |
| 65C3 68D5 | L5 | 43 | EMVMTQSPATLSVSPGERATLSCRASQSVSS QLAWYQEKPGRAPRLLIYGASNRAIDIPARL SGSGSGTEFTLTISSLQSEDFAVYYCQQYNN WPWTFGQGTKVEFKRTVAAPSVFIFPPSDEQ LKSGTASVVCLLNNFYPREAKVQWKVDNAL QSGNSQESVTEQDSKDSTYSLSSTLTLSKAD YEKHKVYACEVTHQGLSSPVTKSFNRGEC |
| 67F5 | L32 | 44 | EIVMTQSPATLSVSPGERVTLSCRASQSVSSN LAWYQQKPGQAPRLLIHGSSNRAIGIPARFS GSGSGTEFTLTISSLQSADFAVYNCQQYEIWP WTFGQGTKVEIKRTVAAPSVFIFPPSDEQLKS GTASVVCLLNNFYPREAKVQWKVDNALQS GNSQESVTEQDSKDSTYSLSSTLTLSKADYE KHKVYACEVTHQGLSSPVTKSFNRGEC |
| 64B10v1 64B10v2 | L33 | 45 | QSVLTQPPSVSAAPGQKVTISCSGSSSNIGNN YVAWYQQLPGTAPKLLIYDNDKRPSGIPDRF SGSKSGTSATLGITGLQTGDEADYYCGTWDS SLSAVVFGGGTKLTVLGQPKANPTVTLFPPS SEELQANKATLVCLISDFYPGAVTVAWKAD GSPVKAGVETTKPSKQSNNKYAASSYLSLTP EQWKSHRSYSCQVTHEGSTVEKTVAPTECS |
| 68C8 | L34 | 46 | QSVLTQPPSVSAAPGQKVTISCSGSSSNIGNN YVSWYQQLPGTAPKLLIYDNNKRPSGIPDRF SGSKSGTSATLGITGLQTGDEADYYCGTWDS SLSAVVFGGGTKLTVLGQPKANPTVTLFPPS SEELQANKATLVCLISDFYPGAVTVAWKAD GSPVKAGVETTKPSKQSNNKYAASSYLSLTP EQWKSHRSYSCQVTHEGSTVEKTVAPTECS |
| 67A5 | L35 | 47 | DIVMTQTPLSLPVTPGEPASISCRSSQSLLNSD DGNTYLDWYLQKPGQSPQLLIYTLSYRASG VPDRFSGTGSGTEFTLKISRVEAEDVGVYYC MQRLEFPITFGQGTRLEIKRTVAAPSVFIFPPS DEQLKSGTASVVCLLNNFYPREAKVQWKVD NALQSGNSQESVTEQDSKDSTYSLSSTLTLS KADYEKHKVYACEVTHQGLSSPVTKSFNRG EC |
| 67C10 | L36 | 48 | DFVMTQTPLSLPVTPGEPASISCRSSQSLLNS DDGNTYLDWYLQKPGQSPQLLIYTLSYRAS GVPDRFSGSGSGTDFTLKISRVEAEDVGVYY CMQRIEFPITFGQGTRLEIKRTVAAPSVFIFPP SDEQLKSGTASVVCLLNNFYPREAKVQWKV DNALQSGNSQESVTEQDSKDSTYSLSSTLTL SKADYEKHKVYACEVTHQGLSSPVTKSFNR GEC |
| 64H6 | L37 | 49 | SYELTQPLSVSVALGQTARITCGGNNIGSKN VHWYQQKPGQAPVVVIYRDSKRPSGIPERFS GSNSGNTATLTISRAQAGDEADYYCQVWDS |

TABLE 1A-continued

Exemplary Antibody Light Chain Sequences

| Contained in Clone | Designation | SEQ ID NO: | Amino Acid Sequence |
|---|---|---|---|
| | | | SPVVFGGGTKLTVLGQPKANPTVTLFPPSSEE LQANKATLVCLISDFYPGAVTVAWKADGSP VKAGVETTKPSKQSNNKYAASSYLSLTPEQ WKSHRSYSCQVTHEGSTVEKTVAPTECS |
| 63F9 | L38 | 50 | DIQMTQSPSSLSVSVGDRVTITCRASQDIRND LAWYQQTPGKAPKRLIYASSSLQSGVPSRFS GTGSGTEFTLTISSLQPEDFATYFCLQRNSYP LTFGGGTKVEIKRTVAAPSVFIFPPSDEQLKS GTASVVCLLNNFYPREAKVQWKVDNALQS GNSQESVTEQDSKDSTYSLSSTLTLSKADYE KHKVYACEVTHQGLSSPVTKSFNRGEC |
| 67F6v1 | L39 | 51 | DIVMTQTPLSLPVIPGEPASIFCRSSQSLLNSD AGTTYLDWYLQKPGQSPQLLIYTLSFRASGV PDRFSGSGSGTDFTLKITRVEAEDVGVYYCM QRIEFPITFGQGTRLEIKRTVAAPSVFIFPPSDE QLKSGTASVVCLLNNFYPREAKVQWKVDN ALQSGNSQESVTEQDSKDSTYSLSSTLTLSK ADYEKHKVYACEVTHQGLSSPVTKSFNRGEC |
| 67F6v2 | L108 | 1842 | DIVMTQTPLSLPVIPGEPASIFCRSSQSLLNSD AGTTYLDWYLQKPGRSPQLLIYTLSFRASGV PDRFSGSGSGTDFTLKITRVEAEDVGVYYCM QRIEFPITFGQGTRLEIKRTVAAPSVFIFPPSDE QLKSGTASVVCLLNNFYPREAKVQWKVDN ALQSGNSQESVTEQDSKDSTYSLSSTLTLSK ADYEKHKVYACEVTHQGLSSPVTKSFNRGEC |
| 48C9 49A12 51E2 | L78 | 52 | DIQMTQSPSSLSASIGDRVTITCRASQNIRTYL NWYQQKPGKAPKLLIYVASSLESGVPSRFSG TGSGTDFALTISSLQPEDFATYYCQQSDSIPR TFGQGTKVEIKRTVAAPSVFIFPPSDEQLKSG TASVVCLLNNFYPREAKVQWKVDNALQSG NSQESVTEQDSKDSTYSLSSTLTLSKADYEK HKVYACEVTHQGLSSPVTKSFNRGEC |
| 48F3 | L77 | 53 | DIQMTQSPSSLSASVGDRVTITCRASQRISSY LNWYQQKPGKAPKFLIYAVSSLQSGVPSRFS GSGSGTDFTLTISSLEPEDFATYYCQQSYSAT FTFGPGTKVDIKRTVAAPSVFIFPPSDEQLKS GTASVVCLLNNFYPREAKVQWKVDNALQS GNSQESVTEQDSKDSTYSLSSTLTLSKADYE KHKVYACEVTHQGLSSPVTKSFNRGEC |
| 48F8 53B9 56B4 57E7 57F11 | L49 | 54 | EIVLTQSPDFQSVTPKEKVTITCRASQDIGNS LHWYQQKPDQSPKLLIKFASQSFSGVPSRFS GSGSGTDFALTINSLEAEDAATYYCHQSSDL PLTFGGGTKVDIKRTVAAPSVFIFPPSDEQLK SGTASVVCLLNNFYPREAKVQWKVDNALQS GNSQESVTEQDSKDSTYSLSSTLTLSKADYE KHKVYACEVTHQGLSSPVTKSFNRGEC |
| 48H11 | L40 | 55 | DIQMTQSPSSLSTSVGDRVTITCRASQNIRSY LNWYQLKPGKAPKVLIYGASNLQSGVPSRFS GSGSGTDFTLTISNLQSEDFAIYYCQQSYNTP CSFGQGTKLEIKRTVAAPSVFIFPPSDEQLKS GTASVVCLLNNFYPREAKVQWKVDNALQS GNSQESVTEQDSKDSTYSLSSTLTLSKADYE KHKVYACEVTHQGLSSPVTKSFNRGEC |
| 49A10 48D4 | L65 | 56 | DIVMTQTPLSLPVTPGEPASISCRSSQSLLDSD DGNTYLDWYLQKPGQSPQLLIYTLSYRASG VPDRFSGSGSGTDFTLKISRVEAEDVGVYYC MQRIEFPITFGQGTRLEIKRTVAAPSVFIFPPS DEQLKSGTASVVCLLNNFYPREAKVQWKVD NALQSGNSQESVTEQDSKDSTYSLSSTLTLS KADYEKHKVYACEVTHQGLSSPVTKSFNRG EC |
| 49C8 52H1 | L45 | 57 | DIQMTQSPSSLSASVGDRVTFTCQASQDINIY LNWYQQKPGKAPKLLIYDVSNLETGVPSRFS GSGSGTDFTFTISSLQPEDIATYFCQQYDNLP FTFGPGTKVDLKRTVAAPSVFIFPPSDEQLKS GTASVVCLLNNFYPREAKVQWKVDNALQS |

TABLE 1A-continued

Exemplary Antibody Light Chain Sequences

| Contained in Clone | Designation | SEQ ID NO: | Amino Acid Sequence |
|---|---|---|---|
| | | | GNSQESVTEQDSKDSTYSLSSTLTLSKADYE KHKVYACEVTHQGLSSPVTKSFNRGEC |
| 49G2 50C12 55G11 | L66 | 58 | DIVLTQTPLSLPVTPGEPASISCRSSQSLLDSD DGDTYLDWYLQKPGQSPQLLIYTLSYRASG VPDRFSGSGSGTDFTLKISRVEAEDVGVYYC MQHIEFPSTFGQGTRLEIKRTVAAPSVFIFPPS DEQLKSGTASVVCLLNNFYPREAKVQWKVD NALQSGNSQESVTEQDSKDSTYSLSSTLTLS KADYEKHKVYACEVTHQGLSSPVTKSFNRG EC |
| 49G3 | L47 | 59 | DIQMTQSPSSLSASIGDRVTITCQASQGISNYL NWYQQKPGKAPKLLIYDASNLETGVPSRFSG SGSGTDFTFTISSLQPEDIATYYCHQYDDLPL TFGGGTKVEIRRTVAAPSVFIFPPSDEQLKSG TASVVCLLNNFYPREAKVQWKVDNALQSG NSQESVTEQDSKDSTYSLSSTLTLSKADYEK HKVYACEVTHQGLSSPVTKSFNRGEC |
| 49H12 | L43 | 60 | DIQMTQSPSSLSASVGDRVTITCQASQDITKY LNWYQQKPGKAPKLLIYDTFILETGVPSRFS GSGSGTDFTFTISSLQPEDIATYYCQQYDNLP LTFGQGTRLEIKRTVAAPSVFIFPPSDEQLKS GTASVVCLLNNFYPREAKVQWKVDNALQS GNSQESVTEQDSKDSTYSLSSTLTLSKADYE KHKVYACEVTHQGLSSPVTKSFNRGEC |
| 51A8 | L61 | 61 | NFILTQPHSVSESPGKTVTISCTRSSGSIASDY VQWYQQRPGSSPTTVIYEDKERSSGVPDRFS GSIDSSSNSASLTISGLKTEDEADYYCQSYDR NNHVVFGGGTKLTVLGQPKANPTVTLFPPSS EELQANKATLVCLISDFYPGAVTVAWKADG SPVKAGVETTKPSKQSNNKYAASSYLSLTPE QWKSHRSYSCQVTHEGSTVEKTVAPTECS |
| 51C10.1 | L55 | 62 | SYELTQPPSVSVSPGQTARITCSGDALPKKYA YWYQQKSGQAPVLVIYEDSKRPSGIPERFSG SISGTMATLTISGAQVEDEADYYCYSTDSSV NHVVFGGGTKLTVLGQPKANPTVTLFPPSSE ELQANKATLVCLISDFYPGAVTVAWKADGS PVKAGVETTKPSKQSNNKYAASSYLSLTPEQ WKSHRSYSCQVTHEGSTVEKTVAPTECS |
| 51C10.2 | L70 | 63 | SYDLTQPPSVSVSPGQTASITCSGDELGDKY ACWYQQKPGQSPVLVIYQDTKRPSGIPERFS GSNSGNTATLTISGTQAMDEADYYCQAWDS GTVVFGGGTKLTVLGQPKANPTVTLFPPSSE ELQANKATLVCLISDFYPGAVTVAWKADGS PVKAGVETTKPSKQSNNKYAASSYLSLTPEQ WKSHRSYSCQVTHEGSTVEKTVAPTECS |
| 51E5 | L79 | 64 | DIQMTQSPSSLSASVGDRVTITCRASQDIRND LGWYQQKPGKAPNRLIYAASSLQFGVPSRFS GSGSGTEFTLTISSLQPEDFATYYCLQHSSYP LTFGGGTRVEIKRTVAAPSVFIFPPSDEQLKS GTASVVCLLNNFYPREAKVQWKVDNALQS GNSQESVTEQDSKDSTYSLSSTLTLSKADYE KHKVYACEVTHQGLSSPVTKSFNRGEC |
| 51G2 | L51 | 65 | DIQMTQSPSVSASVGDRVTITCRASQGISSW LAWYQQKPGKAPKLLIYDASSLQSGVPSRFS GSGSGTDFTLTISSLQPEDFATYYCQQTNSFP PWTFGQGTKVEIKRTVAAPSVFIFPPSDEQLK SGTASVVCLLNNFYPREAKVQWKVDNALQS GNSQESVTEQDSKDSTYSLSSTLTLSKADYE KHKVYACEVTHQGLSSPVTKSFNRGEC |
| 52A8 | L41 | 66 | DIQMTQSPSFLSASVGDRVTITCRASQTISSY LNWHQQKPGKAPKLLIYAASSLQSGVPSRFS GSGSGTDFSLTISSLQPEDFATYYCQQSYSTP LTFGGGTKVEIKRTVAAPSVFIFPPSDEQLKS GTASVVCLLNNFYPREAKVQWKVDNALQS GNSQESVTEQDSKDSTYSLSSTLTLSKADYE KHKVYACEVTHQGLSSPVTKSFNRGEC |

TABLE 1A-continued

Exemplary Antibody Light Chain Sequences

| Contained in Clone | Designation | SEQ ID NO: | Amino Acid Sequence |
|---|---|---|---|
| 52B8 | L82 | 67 | EVVLTQSPATLSVSPGGRATLSCRASQSVSDI LAWYQQKPGQAPRLLIYGASTRATGIPARFS GGGSGTEFTLTISSLQSEDFAVYFCQQYNNW PLTFGGGTKVEIKRTVAAPSVFIFPPSDEQLK SGTASVVCLLNNFYPREAKVQWKVDNALQS GNSQESVTEQDSKDSTYSLSSTLTLSKADYE KHKVYACEVTHQGLSSPVTKSFNRGEC |
| 52C1 | L67 | 68 | QSVLTQPPSVSAAPGQKVTISCSGSSSNIGINY VSWYQQLPGTAPKLLIYDNNKRPSGIPDRFS GSKSGTSATLGITGLQTGDEADYCCGTWDSS LSAVVFGGGTKLTVLGQPKANPTVTLFPPSS EELQANKATLVCLISDFYPGAVTVAWKADG SPVKAGVETTKPSKQSNNKYAASSYLSLTPE QWKSHRSYSCQVTHEGSTVEKTVAPTECS |
| 52F8 | L42 | 69 | DIVMTQSPLSLPVTPGEPASISCRSSQSLLHSN GYNYLDWYLQKPGQSPQLLIYLGSNRASGV PDRFSGRGSGTDFSLKISRVEAEDVGIYYCM QALQTPFTFGPGTNVDIKQTVAAPSVFIFPPS DEQLKSGTASVVCLLNNFYPREAKVQWKVD NALQSGNSQESVTEQDSKDSTYSLSSTLTLS KADYEKHKVYACEVTHQGLSSPVTKSFNRG EC |
| 52H2 | L84 | 70 | ENVLTQSPGTLSLSPGERATLSCRASQSVRSS YLAWYQQRPGQAPRLLIFGASRRATGIPDRF SGSGSGTDFTLTISRLEPEDFAVYYCQQYGSS PRSFGQGTKLEIKRTVAAPSVFIFPPSDEQLKS GTASVVCLLNNFYPREAKVQWKVDNALQS GNSQESVTEQDSKDSTYSLSSTLTLSKADYE KHKVYACEVTHQGLSSPVTKSFNRGEC |
| 53F6 | L63 | 71 | DIVMTQSPLSLPVTPGEPASISCRSSQSLQHSN GYNYLDWYLQKPGQSPQLLIYLDSNRASGV PDRFSGSGSGTDFTLKISRVEAEDIGVYYCM QGLQTPPTFGGGTKVEIKRTVAAPSVFIFPPS DEQLKSGTASVVCLLNNFYPREAKVQWKVD NALQSGNSQESVTEQDSKDSTYSLSSTLTLS KADYEKHKVYACEVTHQGLSSPVTKSFNRG EC |
| 53H5.2 | L62 | 72 | DIQMTQSPSSLSASVGDRVTITCRASQGIRND LGWYQQKPGKAPKRLIYAASSLQSGVPSRFS GSGSGTEFTLTISSLQPEDFATYYCLQHKSYP FTFGPGTKMDIKGTVAAPSVFIFPPSDEQLKS GTASVVCLLNNFYPREAKVQWKVDNALQS GNSQESVTEQDSKDSTYSLSSTLTLSKADYE KHKVYACEVTHQGLSSPVTKSFNRGEC |
| 53H5.3 | L80 | 73 | EIVMTQSPVTLSVSPGERAIISCRASQSVSSNV AWYQQKPGQTPRLLIYGASTRATGLPTRFSG SGSGTVFTLTISSLQPEDFAVYYCQQFSNSITF GQGTRLEIKRTVAAPSVFIFPPSDEQLKSGTA SVVCLLNNFYPREAKVQWKVDNALQSGNS QESVTEQDSKDSTYSLSSTLTLSKADYEKHK VYACEVTHQGLSSPVTKSFNRGEC |
| 54A1 55G9 | L44 | 74 | DIQMAQSPSSLSASVGDRVTITCQASQDISIY LNWYQLKPGKAPKLLIYDVSNLETGVPSRFS GGGSGTDFTFTISSLQPEDIATYYCQQYDNLP LTFGPGTKVDIKRTVAAPSVFIFPPSDEQLKS GTASVVCLLNNFYPREAKVQWKVDNALQS GNSQESVTEQDSKDSTYSLSSTLTLSKADYE KHKVYACEVTHQGLSSPVTKSFNRGEC |
| 54H10.1 55D1 48H3 53C11 | L53 | 75 | EIVVTQSPGTLSLSVGERAILSCRASQSFSSSY LAWYQQKPGQAPRLLIYGASSRATGIPDRFS GSGSGTDFTLTISRLEPEDFAVYYCQQYGSSR TFGQGTKVEIKRTVAAPSVFIFPPSDEQLKSG TASVVCLLNNFYPREAKVQWKVDNALQSG NSQESVTEQDSKDSTYSLSSTLTLSKADYEK HKVYACEVTHQGLSSPVTKSFNRGEC |

TABLE 1A-continued

Exemplary Antibody Light Chain Sequences

| Contained in Clone | Designation | SEQ ID NO: | Amino Acid Sequence |
|---|---|---|---|
| 55D3 | L71 | 76 | DIQMTQSPSSLSVSVGDRVTITCRASQDISNY LAWFQQKPGKAPKSLIYAASSLQSGVPSKFS GSGSGTDFTLTISSLQPEDFATYYCQQYNIYP RTFGQGTKVEIKRTVAAPSVFIFPPSDEQLKS GTASVVCLLNNFYPREAKVQWKVDNALQS GNSQESVTEQDSKDSTYSLSSTLTLSKADYE KHKVYACEVTHQGLSSPVTKSFNRGEC |
| 55E4 49B11 50H10 53C1 | L75 | 77 | DIQMTQSPSSLSTSIGDRITITCRASQSISNYLN WFQQIPGKAPRLLIYTASSLQSGVPSRFSGSG SGTDFTLTISSLQPEDFATYYCQQSSSIPWTF GQGTKVEIKRTVAAPSVFIFPPSDEQLKSGTA SVVCLLNNFYPREAKVQWKVDNALQSGNS QESVTEQDSKDSTYSLSSTLTLSKADYEKHK VYACEVTHQGLSSPVTKSFNRGEC |
| 55E9 | L68 | 78 | DIVMTQSPLSLPVTPGEPASISCRSSQSLLHSN GFNYLDWYLQKPGQSPQVLIYLGSNRASGV PDRFSGSGSGTDFTLKISRVEAEDVGIYYCM QALQTLITFGQGTRLEIKRTVAAPSVFIFPPSD EQLKSGTASVVCLLNNFYPREAKVQWKVDN ALQSGNSQESVTEQDSKDSTYSLSSTLTLSK ADYEKHKVYACEVTHQGLSSPVTKSFNRGEC |
| 55G5 | L83 | 79 | SYELTQPPSVSVSPGQTASITCSGDNLGDKY AFWYQQKPGQSPVLVIYQDNKRPSGIPERFS GSNSGNTATLTISGTQAVDEADYYCQAWDS ATVIFGGGTKLTVLGQPKANPTVTLFPPSSEE LQANKATLVCLISDFYPGAVTVAWKADGSP VKAGVETTKPSKQSNNKYAASSYLSLTPEQ WKSHRSYSCQVTHEGSTVEKTVAPTECS |
| 56A7 56E4 | L52 | 80 | DIQMTQSPSSVSASVGDRVTITCRASQDISSW LAWYQQKPGKAPKFLIYDASTLQSGVPSRFS GSGSGADFTLTINNLQPEDFATYYCQQTNSF PPWTFGQGTKVEIKRTVAAPSVFIFPPSDEQL KSGTASVVCLLNNFYPREAKVQWKVDNAL QSGNSQESVTEQDSKDSTYSLSSTLTLSKAD YEKHKVYACEVTHQGLSSPVTKSFNRGEC |
| 56C11 | L64 | 81 | SYVLTQPPSVSVAPGQAARITCGGNDIGSKS VHWYQQKPGQAPVLVVYDDSDRPSGIPERF SGSKSGNTATLIISRVEAGEEADYYCQVWDS SSDVVFGGGTKLTVLGQPKANPTVTLFPPSS EELQANKATLVCLISDFYPGAVTVAWKADG SPVKAGVETTKPSKQSNNKYAASSYLSLTPE QWKSHRSYSCQVTHEGSTVEKTVAPTECS |
| 56E7 | L86 | 82 | DLQMTQSPSSLSASVGDRVTITCQASQDIKK FLNWYQQKPGKAPNLLIYDASNLETGVPSRF SGSGSGTDFTFTISSLQPEDIATYYCQQYAILP FTFGPGTTVDIKRTVAAPSVFIFPPSDEQLKS GTASVVCLLNNFYPREAKVQWKVDNALQS GNSQESVTEQDSKDSTYSLSSTLTLSKADYE KHKVYACEVTHQGLSSPVTKSFNRGEC |
| 56G1 | L76 | 83 | DIQMTQSPSSLSASVGDRVTITCRASQSISNY LNWFLQIPGKAPKLLIYAASSLQSGVPSRFSG SGSGTDFTLTINSLQPEDFGTYYCQQSSTIPW TFGQGTKVEIKRTVAAPSVFIFPPSDEQLKSG TASVVCLLNNFYPREAKVQWKVDNALQSG NSQESVTEQDSKDSTYSLSSTLTLSKADYEK HKVYACEVTHQGLSSPVTKSFNRGEC |
| 56G3.3 55B10 | L81 | 84 | EIVLTQSPGTLSLSPGERATLSCRASQSVSRD YLAWYRQKPGQAPRLLVYGASARATGIPDR FSGSGSGTDFTLTISRLEPEDFAVYYCQQYGR SLFTFGPGTKVDIKRTVAAPSVFIFPPSDEQL KSGTASVVCLLNNFYPREAKVQWKVDNAL QSGNSQESVTEQDSKDSTYSLSSTLTLSKAD YEKHKVYACEVTHQGLSSPVTKSFNRGEC |
| 57B12 | L72 | 85 | DIQMTQSPSSLSVSVGDRVTITCRASHDISNY LAWFQQKPGKAPKSLIYAASSLQSGVPSKFS GSGSGTDFTLTISSLQPEDFATYYCQQYNTYP |

TABLE 1A-continued

Exemplary Antibody Light Chain Sequences

| Contained in Clone | Designation | SEQ ID NO: | Amino Acid Sequence |
|---|---|---|---|
| | | | RTFGQGTKVEIKRTVAAPSVFIFPPSDEQLKS GTASVVCLLNNFYPREAKVQWKVDNALQS GNSQESVTEQDSKDSTYSLSSTLTLSKADYE KHKVYACEVTHQGLSSPVTKSFNRGEC |
| 57D9 | L87 | 86 | EIVLTQSPGTLSLSPGERATLSCRASPSVSSSY LAWYQQKPAQAPRLLIYGASSRATGIPDRFS GSGSGTDFTLTISRLEPEDFAVYYCHQYGTSP CSFGQGTKLEIKRTVAAPSVFIFPPSDEQLKS GTASVVCLLNNFYPREAKVQWKVDNALQS GNSQESVTEQDSKDSTYSLSSTLTLSKADYE KHKVYACEVTHQGLSSPVTKSFNRGEC |
| 59A10 49H4 | L48 | 87 | DIQMTQSPSSVSASVGDRVTITCRASQGISSW LAWYQQKPGKAPKLLIYGASSLQSGVPSRFS GSGSGTDFTLTISSLQPEDFATYYCQQTNSFP PWTFGQGTKVEIKRTVAAPSVFIFPPSDEQLK SGTASVVCLLNNFYPREAKVQWKVDNALQS GNSQESVTEQDSKDSTYSLSSTLTLSKADYE KHKVYACEVTHQGLSSPVTKSFNRGEC |
| 59C9 58A5 57A4 57F9 | L50 | 88 | DIQMTQSPSSVSASVGDRVTITCRASQDIDS WLVWYQQKPGKAPNLLIYAASNLQRGVPSR FSGSGSGTDFTLTIASLQPEDFATYYCQQTNS FPPWTFGQGTKVEIKRTVAAPSVFIFPPSDEQ LKSGTASVVCLLNNFYPREAKVQWKVDNAL QSGNSQESVTEQDSKDSTYSLSSTLTLSKAD YEKHKVYACEVTHQGLSSPVTKSFNRGEC |
| 59G10.2 | L60 | 89 | SYELSQPPSVSVSPGQTVSITCSGDNLGDKYA CWYQQRPGQSPVLVIYQDTKRPSGIPERFSG SNSGNTATLTISGTQAMDEADYYCQAWDSS TTWVFGGGTKLTVLGQPKANPTVTLFPPSSE ELQANKATLVCLISDFYPGAVTVAWKADGS PVKAGVETTKPSKQSNNKYAASSYLSLTPEQ WKSHRSYSCQVTHEGSTVEKTVAPTECS |
| 59G10.3 | L54 | 90 | QSVLTQPPSVSAAPGQKVTISCSGSSSNIGDN YVSWYQQFPGTAPKLLIYDNNKRPSGIPDRF SGSKSGTSATLGITGLQTGDEADYYCGTWDS SLSVMVFGGGTKLTVLGQPKANPTVTLFPPS SEELQANKATLVCLISDFYPGAVTVAWKAD GSPVKAGVETTKPSKQSNNKYAASSYLSLTP EQWKSHRSYSCQVTHEGSTVEKTVAPTECS |
| 60D7 | L69 | 91 | DIVLTQTPLSLPVTPGEPASISCRSSQSLLDSD DGDTYLDWYLQKPGQSPQLLIYTLSYRASG VPDRFSGSGSGTDFTLKISRVEAEDVGVYYC MQRIEFPLTFGGGTKVEIKRTVAAPSVFIFPPS DEQLKSGTASVVCLLNNFYPREAKVQWKVD NALQSGNSQESVTEQDSKDSTYSLSSTLTLS KADYEKHKVYACEVTHQGLSSPVTKSFNRG EC |
| 60F9 48B4 52D6 | L58 | 92 | EIMLTQSPGTLSLSPGERATLSCRASQRVPSS YIVWYQQKPGQAPRLLIYGSSNRATGIPDRF SGSGSGTDFTLTIGRLEPEDFAVYYCQQYGS SPPWTFGQGTKVAIKRTVAAPSVFIFPPSDEQ LKSGTASVVCLLNNFYPREAKVQWKVDNAL QSGNSQESVTEQDSKDSTYSLSSTLTLSKAD YEKHKVYACEVTHQGLSSPVTKSFNRGEC |
| 60G5.2 | L46 | 93 | SYELTQPPSVSVSPGQTASITCSGNKLGDKY VCWYQQKPGQSPVLVIYQDSKRPSGIPERFS GSNSGNTATLTISGTQALDEADYYCQAWDS STWVFGGGTKLTVLGQPKANPTVTLFPPSSE ELQANKATLVCLISDFYPGAVTVAWKADGS PVKAGVETTKPSKQSNNKYAASSYLSLTPEQ WKSHRSYSCQVTHEGSTVEKTVAPTECS |
| 61G5 | L59 | 94 | EIMLTQSPGTLSLSPGERATLSCRASQRVPSS YLVWYQQKPGQAPRLLIYGASNRATGIPDRF SGSGSGTDFTLTIGRLEPEDFAVYYCQQYGS SPPWTFGQGTKVAIKRTVAAPSVFIFPPSDEQ LKSGTASVVCLLNNFYPREAKVQWKVDNAL |

TABLE 1A-continued

Exemplary Antibody Light Chain Sequences

| Contained in Clone | Designation | SEQ ID NO: | Amino Acid Sequence |
|---|---|---|---|
| | | | QSGNSQESVTEQDSKDSTYSLSSTLTLSKAD YEKHKVYACEVTHQGLSSPVTKSFNRGEC |
| 52C5 | L73 | 95 | DIQMTQSPSSLSASIGDRVTITCRASQSISNYL NWFQQIPGKAPRLLIYAASSLQSGVPSRFSGS GSGTDFTLTISSLQPEDFAIYYCQQSSSIPWTF GQGTKVEIKRTVAAPSVFIFPPSDEQLKSGTA SVVCLLNNFYPREAKVQWKVDNALQSGNS QESVTEQDSKDSTYSLSSTLTLSKADYEKHK VYACEVTHQGLSSPVTKSFNRGEC |
| 61H5 52B9 | L88 | 96 | EIVLTQSPGTLSLSPGERATLSCRASQSVSRD YLAWYRQKPGQAPRLLIYGASSRATGIPDRF SGSGSGTDFTLTISRLEPEDFAVYYCQQYGRS LFTFGPGTTVDIKRTVAAPSVFIFPPSDEQLKS GTASVVCLLNNFYPREAKVQWKVDNALQS GNSQESVTEQDSKDSTYSLSSTLTLSKADYE KHKVYACEVTHQGLSSPVTKSFNRGEC |
| 59D10v1 | L56 | 97 | SYELTQPPSVSVSPGQTARITCSGDAVPKKY ANWYQQKSGQAPVLVIYEDSKRPSGIPERFS GSSSGTMATLTISGAQVEDEADYYCYSTDSS GNHVVFGGGTKLTVLGQPKANPTVTLFPPSS EELQANKATLVCLISDFYPGAVTVAWKADG SPVKAGVETTKPSKQSNNKYAASSYLSLTPE QWKSHRSYSCQVTHEGSTVEKTVAPTECS |
| 59D10v2 | L57 | 98 | SYELTQPPSVSVSPGQTASITCSGDKLGDKY VCWYQQMPGQSPVLVIHQNNKRPSGIPERFS GSNSGNTATLTISGTQAMDEADYYCQAWDS STAVFGGGTKLTVLGQPKANPTVTLFPPSSE ELQANKATLVCLISDFYPGAVTVAWKADGS PVKAGVETTKPSKQSNNKYAASSYLSLTPEQ WKSHRSYSCQVTHEGSTVEKTVAPTECS |
| 56G3.2 | L85 | 99 | ETVMTQSPATLSVSPGERATLSCRARQSVGS NLIWYQQKPGQAPRLLIFGASSRDTGIPARFS GSGSGTEFTLTISSLQSEDFAVYYCQQYNNW PLTFGGGTKVEIKRTVAAPSVFIFPPSDEQLK SGTASVVCLLNNFYPREAKVQWKVDNALQS GNSQESVTEQDSKDSTYSLSSTLTLSKADYE KHKVYACEVTHQGLSSPVTKSFNRGEC |
| 68G5 | L13 | 100 | SYELTQPLSVSVALGQTARLTCGGNNIGSIN VHWYQQKPGQAPVLVIYRDNRPSGIPERFS GSNSGNTATLTISRAQAGDEADYYCQLWDS STVVFGGGTKLTVLGQPKANPTVTLFPPSSE ELQANKATLVCLISDFYPGAVTVAWKADGS PVKAGVETTKPSKQSNNKYAASSYLSLTPEQ WKSHRSYSCQVTHEGSTVEKTVAPTECS |
| 60G5.1 | L74 | 1843 | DIQMTQSPSSLSASIGDRVTITCRASQSISNYL NWFQQIPGKAPRLLIYAASSLQSGVPSRFSGS GSGTDFTLTISSLQPEDFATYYCQQSSSIPWT FGQGTKVEIKRTVAAPSVFIFPPSDEQLKSGT ASVVCLLNNFYPREAKVQWKVDNALQSGN SQESVTEQDSKDSTYSLSSTLTLSKADYEKH KVYACEVTHQGLSSPVTKSFNRGEC |
| 48G4 53C3.1 | L89 | 101 | EIVLTQSPGTLSLSPGERATLSCRASQSVASS YLVWYQQKPGQAPRLLIYGAFSRATGIPDRF SGSGSGTDFTLTIRRLEPEDFAVYYCQQYGT SPFTFGPGTKVDLKRTVAAPSVFIFPPSDEQL KSGTASVVCLLNNFYPREAKVQWKVDNAL QSGNSQESVTEQDSKDSTYSLSSTLTLSKAD YEKHKVYACEVTHQGLSSPVTKSFNRGEC |
| 50G1 | L90 | 102 | DIVMTQTPLSLPVSPGEPASISCRSSQSLLDSD DGDTYLDWYLQKPGQSPQLLIYTLSYRASG VPDRFSVSGSGTDFTLKISRVEAEDVGVYYC MQRIEFPLTFGGGTKVEIKRTVAAPSVFIFPPS DEQLKSGTASVVCLLNNFYPREAKVQWKVD NALQSGNSQESVTEQDSKDSTYSLSSTLTLS KADYEKHKVYACEVTHQGLSSPVTKSFNRG EC |

TABLE 1A-continued

Exemplary Antibody Light Chain Sequences

| Contained in Clone | Designation | SEQ ID NO: | Amino Acid Sequence |
|---|---|---|---|
| 58C2 | L91 | 103 | EIVMTQTPLSLPVTPGEPASISCRSSQSLFDND DGDTYLDWYLQKPGQSPQLLIYTLSYRASG VPDRFSGSGSGTDFTLKISRVEAEDVGVYYC MQRLEFPITFGQGTRLEIKRTVAAPSVFIFPPS DEQLKSGTASVVCLLNNFYPREAKVQWKVD NALQSGNSQESVTEQDSKDSTYSLSSTLTLS KADYEKHKVYACEVTHQGLSSPVTKSFNRG EC |
| 50D4 | L92 | 104 | DIQMTQSPSSLSASVGDRVTITCRASQDISNY LAWYQQKPGKVPTLLIYAASTLLSGVPSRFS GSGSGTDFTLTISSLQPEDVAAYYCQKYYSA PFTFGPGTKVDINRTVAAPSVFIFPPSDEQLKS GTASVVCLLNNFYPREAKVQWKVDNALQS GNSQESVTEQDSKDSTYSLSSTLTLSKADYE KHKVYACEVTHQGLSSPVTKSFNRGEC |
| 50G5v1 | L93 | 105 | DIQMTQSPSSLSASVGDRVTITCRASQGIRND LGWYQQKPGKAPNRLIYAASSLQSGVPSRFS GSGSGTEFTLTISSLQPEDFATYYCLQHNSYP RTFGQGTKVEIKRTVAAPSVFIFPPSDEQLKS GTASVVCLLNNFYPREAKVQWKVDNALQS GNSQESVTEQDSKDSTYSLSSTLTLSKADYE KHKVYACEVTHQGLSSPVTKSFNRGEC |
| 50G5v2 | L94 | 106 | DVVMTQCPLSLPVTLGQPASISCRSSQRLVY SDGNTYLNWVQQRPGQSPRRLIYKVSNWDS GVPDRFSGSGSGTDFTLKISRVEAEDVGVNY CMEGTHWPRDFGQGTRLEIKRTVAAPSVFIF PPSDEQLKSGTASVVCLLNNFYPREAKVQW KVDNALQSGNSQESVTEQDSKDSTYSLSSTL TLSKADYEKHKVYACEVTHQGLSSPVTKSF NRGEC |
| 51C1 | L95 | 107 | DIQMTQSPSSLSASIGDRVTITCRASQSISNYL NWFQQIPGKAPRLLIYAASSLQSGVPSRFSGS GSGTDFTLTISSLQPEDFATYYCQQSSSIPWT FGQGTTVEIKRTVAAPSVFIFPPSDEQLKSGT ASVVCLLNNFYPREAKVQWKVDNALQSGN SQESVTEQDSKDSTYSLSSTLTLSKADYEKH KVYACEVTHQGLSSPVTKSFNRGEC |
| 53C3.2 | L96 | 108 | DIVMTQSPATLSVSPGERATLSCRASQSISSN LAWYQQTPGQAPRLLIYGTSIRASTIPARFSG SGSGTEFTLTISSLQSEDFAIYYCHQYTNWPR TFGQGTKVEIKRTVAAPSVFIFPPSDEQLKSG TASVVCLLNNFYPREAKVQWKVDNALQSG NSQESVTEQDSKDSTYSLSSTLTLSKADYEK HKVYACEVTHQGLSSPVTKSFNRGEC |
| 54H10.3 | L97 | 109 | DIQMTQSPSSLSASVGDRVTITCRASQTISIYL NWYQQKPGKAPKFLIYSASSLQSGVPSRFSG SGSGTDFTLTISSLQPEDFSTYFCQQSYSSPLT FGGGTKVEIKRTVAAPSVFIFPPSDEQLKSGT ASVVCLLNNFYPREAKVQWKVDNALQSGN SQESVTEQDSKDSTYSLSSTLTLSKADYEKH KVYACEVTHQGLSSPVTKSFNRGEC |
| 55A7 | L98 | 110 | DIQMTQSPSSLSASVGDRVTITCRASQSISSYL NWYQQKPGKAPKLLIYAASSLQSGVPSRFSG SGSGTDFTLTISSLQPEDFATYYCQQTYSAPF TFGPGTKVDIKRTVAAPSVFIFPPSDEQLKSG TASVVCLLNNFYPREAKVQWKVDNALQSG NSQESVTEQDSKDSTYSLSSTLTLSKADYEK HKVYACEVTHQGLSSPVTKSFNRGEC |
| 55E6 | L99 | 111 | EIVLTQSPGTLSLSPGERATLSCRASQSVSRS HLAWYQQNSGQAPRLLIYGASSRATGIPDRF SGSGSGTDFTLTISRLEPEDFAVYYCQQYGSS PWTFGQGTKVEIKRTVAAPSVFIFPPSDEQLK SGTASVVCLLNNFYPREAKVQWKVDNALQS GNSQESVTEQDSKDSTYSLSSTLTLSKADYE KHKVYACEVTHQGLSSPVTKSFNRGEC |

TABLE 1A-continued

Exemplary Antibody Light Chain Sequences

| Contained in Clone | Designation | SEQ ID NO: | Amino Acid Sequence |
|---|---|---|---|
| 61E1 | L100 | 112 | DIQMTQSPSSLSASIRDRVTITCRASQSIGTFL NWYQQKPGTAPKLLIYAASSLQSGVPSRFSG SGSGTDFTLTISSLHPEDFASYYCQQSFSTPLT FGGGTKVEITRTVAAPSVFIFPPSDEQLKSGT ASVVCLLNNFYPREAKVQWKVDNALQSGN SQESVTEQDSKDSTYSLSSTLTLSKADYEKH KVYACEVTHQGLSSPVTKSFNRGEC |

TABLE 1B

Exemplary Antibody Heavy Chain Sequences

| Contained in Clone | Designation | SEQ ID NO: | Amino Acid Sequence |
|---|---|---|---|
| 63E6 66F7 | H6 | 113 | QVQLMQSGAEVKKPGASVKVSCKASGYTFTG YYMHWVRQAPGQGLEWMGWMNPNSGATKY AQKFQGRVTMTRDTSISTAYMELSRLRSDDTA VYYCARELGDYPFFDYWGQGTLGIVSSASTKG PSVFPLAPCSRSTSESTAALGCLVKDYFPEPVTV SWNSGALTSGVHTFPAVLQSSGLYSLSSVVTVP SSNFGTQTYTCNVDHKPSNTKVDKTVERKCCV ECPPCPAPPVAGPSVFLFPPKPKDTLMISRTPEV TCVVVDVSHEDPEVQFNWYVDGVEVHNAKTK PREEQFNSTFRVVSVLTVVHQDWLNGKEYKC KVSNKGLPAPIEKTISKTKGQPREPQVYTLPPSR EEMTKNQVSLTCLVKGFYPSDIAVEWESNGQP ENNYKTTPPMLDSDGSFFLYSKLTVDKSRWQQ GNVFSCSVMHEALHNHYTQKSLSLSPGK |
| 66D4 | H17 | 114 | QVQLVQSGAEVKKPGASVKVSCRASGYTFTG YYIHWMRQAPGHGLEWMGWINPPSGATNYA QKFRGRVAVTRDTSISTVYMELSRLRSDDTAV YYCARETGTWNFFDYWGQGTLVTVSSASTKG PSVFPLAPCSRSTSESTAALGCLVKDYFPEPVTV SWNSGALTSGVHTFPAVLQSSGLYSLSSVVTVP SSNFGTQTYTCNVDHKPSNTKVDKTVERKCCV ECPPCPAPPVAGPSVFLFPPKPKDTLMISRTPEV TCVVVDVSHEDPEVQFNWYVDGVEVHNAKTK PREEQFNSTFRVVSVLTVVHQDWLNGKEYKC KVSNKGLPAPIEKTISKTKGQPREPQVYTLPPSR EEMTKNQVSLTCLVKGFYPSDIAVEWESNGQP ENNYKTTPPMLDSDGSFFLYSKLTVDKSRWQQ GNVFSCSVMHEALHNHYTQKSLSLSPGK |
| 66B4 | H10 | 115 | QVQLVQSGAEVKKPGASVKVSCKASGYTFTG YYLHWVRQAPGQGLEWMGWINPNSGGTDYA QKFQGRVTMTRDTSISTAYMELSRLRSDDTAV YYCVGDAATGRYYFDNWGQGTLVTVSSASTK GPSVFPLAPCSRSTSESTAALGCLVKDYFPEPVT VSWNSGALTSGVHTFPAVLQSSGLYSLSSVVT VPSSNFGTQTYTCNVDHKPSNTKVDKTVERKC CVECPPCPAPPVAGPSVFLFPPKPKDTLMISRTP EVTCVVVDVSHEDPEVQFNWYVDGVEVHNAK TKPREEQFNSTFRVVSVLTVVHQDWLNGKEYK CKVSNKGLPAPIEKTISKTKGQPREPQVYTLPPS REEMTKNQVSLTCLVKGFYPSDIAVEWESNGQ PENNYKTTPPMLDSDGSFFLYSKLTVDKSRWQ QGNVFSCSVMHEALHNHYTQKSLSLSPGK |
| 65B1 | H18 | 116 | QVQLVQSGAEVKRPGASVKVSCKASGYTFTG YFMHWVRQAPGQGLEWMGWINPNSGATNYA QKFHGRVTMTRDTSITTVYMELSRLRSDDTAV YYCTRELGIFNWFDPWGQGTLVTVSSASTKGP SVFPLAPCSRSTSESTAALGCLVKDYFPEPVTVS WNSGALTSGVHTFPAVLQSSGLYSLSSVVTVPS SNFGTQTYTCNVDHKPSNTKVDKTVERKCCVE CPPCPAPPVAGPSVFLFPPKPKDTLMISRTPEVT CVVVDVSHEDPEVQFNWYVDGVEVHNAKTKP REEQFNSTFRVVSVLTVVHQDWLNGKEYKCK VSNKGLPAPIEKTISKTKGQPREPQVYTLPPSRE |

TABLE 1B-continued

Exemplary Antibody Heavy Chain Sequences

| Contained in Clone | Designation | SEQ ID NO: | Amino Acid Sequence |
|---|---|---|---|
| | | | EMTKNQVSLTCLVKGFYPSDIAVEWESNGQPE NNYKTTPPMLDSDGSFFLYSKLTVDKSRWQQG NVFSCSVMHEALHNHYTQKSLSLSPGK |
| 65B4 | H20 | 117 | EVQLVESGGGLVQPGGSLRLSCAASGFAFSSY DMHWVRQATGKGLEWVSTIDTAGDAYYPGSV KGRFTISRENAKTSLYLQMNSLRAGDTAVYYC TRDRSSGRFGDFYGMDVWGQGTAVTVSSAST KGPSVFPLAPCSRSTSESTAALGCLVKDYFPEP VTVSWNSGALTSGVHTFPAVLQSSGLYSLSSV VTVPSSNFGTQTYTCNVDHKPSNTKVDKTVER KCCVECPPCPAPPVAGPSVFLFPPKPKDTLMISR TPEVTCVVVDVSHEDPEVQFNWYVDGVEVHN AKTKPREEQFNSTFRVVSVLTVVHQDWLNGKE YKCKVSNKGLPAPIEKTISKTKGQPREPQVYTL PPSREEMTKNQVSLTCLVKGFYPSDIAVEWESN GQPENNYKTTPPMLDSDGSFFLYSKLTVDKSR WQQGNVFSCSVMHEALHNHYTQKSLSLSPGK |
| 67A4 | H19 | 118 | EVQLEESGGGLVQPGGSLRLSCAASGFTFRTYD MHWVRQVTGKGLEWVSAIGIAGDTYYSDSVK GRFTISRENAKNSLYLQMNSLRVGDTAVYYCA RDRSSGRFGDYYGMDVWGQGTTVTVSSASTK GPSVFPLAPCSRSTSESTAALGCLVKDYFPEPVT VSWNSGALTSGVHTFPAVLQSSGLYSLSSVVT VPSSNFGTQTYTCNVDHKPSNTKVDKTVERKC CVECPPCPAPPVAGPSVFLFPPKPKDTLMISRTP EVTCVVVDVSHEDPEVQFNWYVDGVEVHNAK TKPREEQFNSTFRVVSVLTVVHQDWLNGKEYK CKVSNKGLPAPIEKTISKTKGQPREPQVYTLPPS REEMTKNQVSLTCLVKGFYPSDIAVEWESNGQ PENNYKTTPPMLDSDGSFFLYSKLTVDKSRWQ QGNVFSCSVMHEALHNHYTQKSLSLSPGK |
| 63A10v1 63A10v2 63A10v3 | H21 | 119 | EVQLVESGGDLVKPGGSLRLSCAVSGITFSNA WMSWVRQAPGKGLEWVGRIKSKTDGGTTDY AAPVKGRFTVSRDGSKNTLYLQMNSLKTEDTA VYYCTTDSSGSYYVEDYFDYWGQGTLVTVSS ASTKGPSVFPLAPCSRSTSESTAALGCLVKDYF PEPVTVSWNSGALTSGVHTFPAVLQSSGLYSLS SVVTVPSSNFGTQTYTCNVDHKPSNTKVDKTV ERKCCVECPPCPAPPVAGPSVFLFPPKPKDTLMI SRTPEVTCVVVDVSHEDPEVQFNWYVDGVEV HNAKTKPREEQFNSTFRVVSVLTVVHQDWLN GKEYKCKVSNKGLPAPIEKTISKTKGQPREPQV YTLPPSREEMTKNQVSLTCLVKGFYPSDIAVE WESNGQPENNYKTTPPMLDSDGSFFLYSKLTV DKSRWQQGNVFSCSVMHEALHNHYTQKSLSL SPGK |
| 65H11v1 65H11v2 | H22 | 120 | EVQLVESGGGLVKPGGSLRLSCAASGFTFSNA WMSWVRQAPGKGLEWVGRIIGKTDGGTTDYA APVKGRFTISRDDSKNTLYLQMNSLKTEDTAV YYCTSDSSGSYYVEDYFDYWGQGTLVAVSSAS TKGPSVFPLAPCSRSTSESTAALGCLVKDYFPEP VTVSWNSGALTSGVHTFPAVLQSSGLYSLSSV VTVPSSNFGTQTYTCNVDHKPSNTKVDKTVER KCCVECPPCPAPPVAGPSVFLFPPKPKDTLMISR TPEVTCVVVDVSHEDPEVQFNWYVDGVEVHN AKTKPREEQFNSTFRVVSVLTVVHQDWLNGKE YKCKVSNKGLPAPIEKTISKTKGQPREPQVYTL PPSREEMTKNQVSLTCLVKGFYPSDIAVEWESN GQPENNYKTTPPMLDSDGSFFLYSKLTVDKSR WQQGNVFSCSVMHEALHNHYTQKSLSLSPGK |
| 67G10v1 67G10v2 | H9 | 121 | EVQLVESGGGLVKPGGSLRLACAASGITFNNA WMSWVRQAPGKGLEWVGRIKSKTDGGTTDY AAPVKGRFTISRDDSKSILYLQMNSLKSEDTAV YYCTTDSSGSYYVEDYFDYWGQGTLVTVSSAS TKGPSVFPLAPCSRSTSESTAALGCLVKDYFPEP VTVSWNSGALTSGVHTFPAVLQSSGLYSLSSV VTVPSSNFGTQTYTCNVDHKPSNTKVDKTVER KCCVECPPCPAPPVAGPSVFLFPPKPKDTLMISR TPEVTCVVVDVSHEDPEVQFNWYVDGVEVHN |

TABLE 1B-continued

Exemplary Antibody Heavy Chain Sequences

| Contained in Clone | Designation | SEQ ID NO: | Amino Acid Sequence |
|---|---|---|---|
| | | | AKTKPREEQFNSTFRVVSVLTVVHQDWLNGKE YKCKVSNKGLPAPIEKTISKTKGQPREPQVYTL PPSREEMTKNQVSLTCLVKGFYPSDIAVEWESN GQPENNYKTTPPMLDSDGSFFLYSKLTVDKSR WQQGNVFSCSVMHEALHNHYTQKSLSLSPGK |
| 64C8 | H23 | 122 | QVQLVESGGGVVQPGRSLRLSCVASGFTFSSY GMHWVRQDPGKGLEWVAVISYDGSNKHYAD SVKGRFTISRDNSKNTLYLQMNSLRAEDTAVY YCARELLWFGEYGVDHGMDVWGQGTTVTVS SASTKGPSVFPLAPCSRSTSESTAALGCLVKDY FPEPVTVSWNSGALTSGVHTFPAVLQSSGLYSL SSVVTVPSSNFGTQTYTCNVDHKPSNTKVDKT VERKCCVECPPCPAPPVAGPSVFLFPPKPKDTL MISRTPEVTCVVVDVSHEDPEVQFNWYVDGVE VHNAKTKPREEQFNSTFRVVSVLTVVHQDWL NGKEYKCKVSNKGLPAPIEKTISKTKGQPREPQ VYTLPPSREEMTKNQVSLTCLVKGFYPSDIAVE WESNGQPENNYKTTPPMLDSDGSFFLYSKLTV DKSRWQQGNVFSCSVMHEALHNHYTQKSLSL SPGK |
| 63G8v1 63G8v2 63G8v3 68D3v1 64A8 67B4 | H1 | 123 | QAQLVESGGGVVQPGRSLRLSCAASGFTFSSY GIHWVRQAPGKGLEWVAVISYDGSNKYYADS VKGRFTISRDNSKNTLYLQMNSLRAEDTAVYY CATTVTKEDYYYGMDVWGQGTTVTVSSAST KGPSVFPLAPCSRSTSESTAALGCLVKDYFPEP VTVSWNSGALTSGVHTFPAVLQSSGLYSLSSV VTVPSSNFGTQTYTCNVDHKPSNTKVDKTVER KCCVECPPCPAPPVAGPSVFLFPPKPKDTLMISR TPEVTCVVVDVSHEDPEVQFNWYVDGVEVHN AKTKPREEQFNSTFRVVSVLTVVHQDWLNGKE YKCKVSNKGLPAPIEKTISKTKGQPREPQVYTL PPSREEMTKNQVSLTCLVKGFYPSDIAVEWESN GQPENNYKTTPPMLDSDGSFFLYSKLTVDKSR WQQGNVFSCSVMHEALHNHYTQKSLSLSPGK |
| 68D3v2 | H95 | 1844 | QAQLVESGGGVVQPGRSLRLSCAASGFTFSSY GMHWVRQAPGKGLEWVAFISYAGSNKYY ADSVKGRFTISRDNSKNTLYLQMSSLRAEDTA VYYCATTVTEEDYYYGMDVWGQGTTVT VSSASTKGPSVFPLAPCSRSTSESTAALGCLVK DYFPEPVTVSWNSGALTSGVHTFPAVLQSSGL YSLSSVVTVPSSNFGTQTYTCNVDHKPSNTKV DKTVERKCCVECPPCPAPPVAGPSVFLFPPKPK DTLMISRTPEVTCVVVDVSHEDPEVQFNWYVD GVEVHNAKTKPREEQFNSTFRVVSVLTVVHQD WLNGKEYKCKVSNKGLPAPIEKTISKTKGQPR EPQVYTLPPSREEMTKNQVSLTCLVKGFYPSDI AVEWESNGQPENNYKTTPPMLDSDGSFFLYSK LTVDKSRWQQGNVFSCSVMHEALHNHYTQKS LSLSPGK |
| 66G2 | H11 | 124 | QVQLVESGGGVVQPGRSLRLSCAASGFTFSSY GMHWVRQAPGKGLEWVAGISYDGSNKNYAD SVKGRITISRDNPKNTLYLQMNSLRAEDTAVY YCATTVTKEDYYYGMDVWGQGTTVTVSSAS TKGPSVFPLAPCSRSTSESTAALGCLVKDYFPEP VTVSWNSGALTSGVHTFPAVLQSSGLYSLSSV VTVPSSNFGTQTYTCNVDHKPSNTKVDKTVER KCCVECPPCPAPPVAGPSVFLFPPKPKDTLMISR TPEVTCVVVDVSHEDPEVQFNWYVDGVEVHN AKTKPREEQFNSTFRVVSVLTVVHQDWLNGKE YKCKVSNKGLPAPIEKTISKTKGQPREPQVYTL PPSREEMTKNQVSLTCLVKGFYPSDIAVEWESN GQPENNYKTTPPMLDSDGSFFLYSKLTVDKSR WQQGNVFSCSVMHEALHNHYTQKSLSLSPGK |
| 65D1 | H26 | 125 | QVQLVESGGGVVQPGRSLRLSCAASGFTFSYY YIHWVRQAPGKGLEWVALIWYDGSNKDYADS VKGRFTISRDNSKNTLYLHVNSLRAEDTAVYY CAREGTTRRGFDYWGQGTLVTVSSASTKGPSV FPLAPCSRSTSESTAALGCLVKDYFPEPVTVSW NSGALTSGVHTFPAVLQSSGLYSLSSVVTVPSS |

TABLE 1B-continued

Exemplary Antibody Heavy Chain Sequences

| Contained in Clone | Designation | SEQ ID NO: | Amino Acid Sequence |
|---|---|---|---|
| | | | NFGTQTYTCNVDHKPSNTKVDKTVERKCCVE CPPCPAPPVAGPSVFLFPPKPKDTLMISRTPEVT CVVVDVSHEDPEVQFNWYVDGVEVHNAKTKP REEQFNSTFRVVSVLTVVHQDWLNGKEYKCK VSNKGLPAPIEKTISKTKGQPREPQVYTLPPSRE EMTKNQVSLTCLVKGFYPSDIAVEWESNGQPE NNYKTTPPMLDSDGSFFLYSKLTVDKSRWQQG NVFSCSVMHEALHNHYTQKSLSLSPGK |
| 64H5 | H7 | 126 | QVQLVESGGGVVQPGRSLRLSCAASGFTFSSY GMHWVRQAPGKGLEWVAVIWDDGSNKYYAD SVKGRFTISRDNSKNTLSLQMNSLRAEDTAVY YCAREYVAEAGFDYWGQGTLVTVSSASTKGP SVFPLAPCSRSTSESTAALGCLVKDYFPEPVTVS WNSGALTSGVHTFPAVLQSSGLYSLSSVVTVPS SNFGTQTYTCNVDHKPSNTKVDKTVERKCCVE CPPCPAPPVAGPSVFLFPPKPKDTLMISRTPEVT CVVVDVSHEDPEVQFNWYVDGVEVHNAKTKP REEQFNSTFRVVSVLTVVHQDWLNGKEYKCK VSNKGLPAPIEKTISKTKGQPREPQVYTLPPSRE EMTKNQVSLTCLVKGFYPSDIAVEWESNGQPE NNYKTTPPMLDSDGSFFLYSKLTVDKSRWQQG NVFSCSVMHEALHNHYTQKSLSLSPGK |
| 65D4 | H25 | 127 | QEQLVESGGGVVQPGRSLRLSCAVSGFTFSFYG MHWVRQAPGKGLEWVAVIWYDGSNKYYADS VKGRFTISRDNSKNTLYLQMNSLRAEDTAVYY CTRALNWNFFDYWGQGTLVTVSSASTKGPSVF PLAPCSRSTSESTAALGCLVKDYFPEPVTVSWN SGALTSGVHTFPAVLQSSGLYSLSSVVTVPSSN FGTQTYTCNVDHKPSNTKVDKTVERKCCVECP PCPAPPVAGPSVFLFPPKPKDTLMISRTPEVTCV VVDVSHEDPEVQFNWYVDGVEVHNAKTKPRE EQFNSTFRVVSVLTVVHQDWLNGKEYKCKVS NKGLPAPIEKTISKTKGQPREPQVYTLPPSREEM TKNQVSLTCLVKGFYPSDIAVEWESNGQPENN YKTTPPMLDSDGSFFLYSKLTVDKSRWQQGNV FSCSVMHEALHNHYTQKSLSLSPGK |
| 65E3 | H24 | 128 | QVQLVESGGGVVQPGRSLRLSCAASGFTLSNY NMHWVRQAPGKGLEWVAVLWYDGNTKYYA DSVKGRVTISRDNSKNTLYLQMNSLRAEDTAV YYCARDVYGDYFAYWGQGTLVTVSSASTKGP SVFPLAPCSRSTSESTAALGCLVKDYFPEPVTVS WNSGALTSGVHTFPAVLQSSGLYSLSSVVTVPS SNFGTQTYTCNVDHKPSNTKVDKTVERKCCVE CPPCPAPPVAGPSVFLFPPKPKDTLMISRTPEVT CVVVDVSHEDPEVQFNWYVDGVEVHNAKTKP REEQFNSTFRVVSVLTVVHQDWLNGKEYKCK VSNKGLPAPIEKTISKTKGQPREPQVYTLPPSRE EMTKNQVSLTCLVKGFYPSDIAVEWESNGQPE NNYKTTPPMLDSDGSFFLYSKLTVDKSRWQQG NVFSCSVMHEALHNHYTQKSLSLSPGK |
| 65G4 | H8 | 129 | QVQLVESGGGVVQPGRSLRLSCAASGFTFSSY GMHWVRQAPGKGLEWVAVIWDDGSNKYY ADSVKGRFTISRDNSKNTLSLQMNSLRAEDTA VYYCAREYVAEAGFDYWGQGTLVTVSSASTK GPSVFPLAPCSRSTSESTAALGCLVKDYFPEPVT VSWNSGALTSGVHTFPAVLQSSGLYSLSSVVT VPSSNFGTQTYTCNVDHKPSNTKVDKTVERKC CVECPPCPAPPVAGPSVFLFPPKPKDTLMISRTP EVTCVVVDVSHEDPEVQFNWYVDGVEVHNAK TKPREEQFNSTFRVVSVLTVVHQDWLNGKEYK CKVSNKGLPAPIEKTISKTKGQPREPQVYTLPPS REEMTKNQVSLTCLVKGFYPSDIAVEWESNGQ PENNYKTTPPMLDSDGSFFLYSKLTVDKSRWQ QGNVFSCSVMHEALHNHYTQKSLSLSPGK |
| 68G5 | H12 | 130 | QVQLVESGGGVVQPGRSLRLSCTASGFTFSSYG MHWVRQAPGKGLEWVAVIWYDGSNKYHADS VKGRFTISRDDSKNALYLQMNSLRAEDTAVYY CVRDPGYSYGHFDYWGQGTLVTVSSASTKGPS VFPLAPCSRSTSESTAALGCLVKDYFPEPVTVS |

TABLE 1B-continued

Exemplary Antibody Heavy Chain Sequences

| Contained in Clone | Designation | SEQ ID NO: | Amino Acid Sequence |
|---|---|---|---|
| | | | WNSGALTSGVHTFPAVLQSSGLYSLSSVVTVPS SNFGTQTYTCNVDHKPSNTKVDKTVERKCCVE CPPCPAPPVAGPSVFLFPPKPKDTLMISRTPEVT CVVVDVSHEDPEVQFNWYVDGVEVHNAKTKP REEQFNSTFRVVSVLTVVHQDWLNGKEYKCK VSNKGLPAPIEKTISKTKGQPREPQVYTLPPSRE EMTKNQVSLTCLVKGFYPSDIAVEWESNGQPE NNYKTTPPMLDSDGSFFLYSKLTVDKSRWQQG NVFSCSVMHEALHNHYTQKSLSLSPGK |
| 67G8 | H27 | 131 | QVQLVESGGGVVQPGRSLRLSCAASGFTFSSY GMHWVRQAPGKGLEWVAVIWYDGSNKDYAD SVKGRFTISRDNSKNTLYLQMNSLRAEDTAVY YCARSAVALYNWFDPWGQGTLVTVSSASTKG PSVFPLAPCSRSTSESTAALGCLVKDYFPEPVTV SWNSGALTSGVHTFPAVLQSSGLYSLSSVVTVP SSNFGTQTYTCNVDHKPSNTKVDKTVERKCCV ECPPCPAPPVAGPSVFLFPPKPKDTLMISRTPEV TCVVVDVSHEDPEVQFNWYVDGVEVHNAKTK PREEQFNSTFRVVSVLTVVHQDWLNGKEYKC KVSNKGLPAPIEKTISKTKGQPREPQVYTLPPSR EEMTKNQVSLTCLVKGFYPSDIAVEWESNGQP ENNYKTTPPMLDSDGSFFLYSKLTVDKSRWQQ GNVFSCSVMHEALHNHYTQKSLSLSPGK |
| 65B7v1 65B7v2 | H28 | 132 | QVQLQESGPGLVNPSQTLSLTCTVSGGSISSDA YYWSWIRQHPGKGLEWIGYIFYSGSTYYNPSL KSRVTISVDTSKNRFSLKLSSVTAADTAVYYCA RESRILYFNGYFQHWGQGTLVTVSSASTKGPS VFPPLAPCSRSTSESTAALGCLVKDYFPEPVTVS WNSGALTSGVHTFPAVLQSSGLYSLSSVVTVPS SNFGTQTYTCNVDHKPSNTKVDKTVERKCCVE CPPCPAPPVAGPSVFLFPPKPKDTLMISRTPEVT CVVVDVSHEDPEVQFNWYVDGVEVHNAKTKP REEQFNSTFRVVSVLTVVHQDWLNGKEYKCK VSNKGLPAPIEKTISKTKGQPREPQVYTLPPSRE EMTKNQVSLTCLVKGFYPSDIAVEWESNGQPE NNYKTTPPMLDSDGSFFLYSKLTVDKSRWQQG NVFSCSVMHEALHNHYTQKSLSLSPGK |
| 63B6 64D4 | H4 | 133 | QVQLQESGPGLVKPSQTLSLTCAVSGGSISSGD YYWSWIRQHPGKGLEWIGYIYYSGTTYYNPSL KSRVTISVDTSKNQFSLKLTSVTAADTAVYYC ARMTTPYWYFGLWGRGTLVTVSSASTKGPSVF PLAPCSRSTSESTAALGCLVKDYFPEPVTVSWN SGALTSGVHTFPAVLQSSGLYSLSSVVTVPSSN FGTQTYTCNVDHKPSNTKVDKTVERKCCVECP PCPAPPVAGPSVFLFPPKPKDTLMISRTPEVTCV VVDVSHEDPEVQFNWYVDGVEVHNAKTKPRE EQFNSTFRVVSVLTVVHQDWLNGKEYKCKVS NKGLPAPIEKTISKTKGQPREPQVYTLPPSREEM TKNQVSLTCLVKGFYPSDIAVEWESNGQPENN YKTTPPMLDSDGSFFLYSKLTVDKSRWQQGNV FSCSVMHEALHNHYTQKSLSLSPGK |
| 63F5 | H13 | 134 | QVQLQESGPGLVKPSQTLSLTCPVSGGSISSGD YYWTWIRQHPGKDLEWITYIYYSGSAYYNPSL KSRVTISVDTSKNQFSLKLSSVTAADTAVYYCA RMTTPYWYFDLWGRGTLVTVSSASTKGPSVFP LAPCSRSTSESTAALGCLVKDYFPEPVTVSWNS GALTSGVHTFPAVLQSSGLYSLSSVVTVPSSNF GTQTYTCNVDHKPSNTKVDKTVERKCCVECPP CPAPPVAGPSVFLFPPKPKDTLMISRTPEVTCVV VDVSHEDPEVQFNWYVDGVEVHNAKTKPREE QFNSTFRVVSVLTVVHQDWLNGKEYKCKVSN KGLPAPIEKTISKTKGQPREPQVYTLPPSREEMT KNQVSLTCLVKGFYPSDIAVEWESNGQPENNY KTTPPMLDSDGSFFLYSKLTVDKSRWQQGNVF SCSVMHEALHNHYTQKSLSLSPGK |
| 63H11 | H3 | 135 | QVQLQESGPGLVKPSQTLSLTCPVSGGSISSGD YYWTWIRQHPGKGLEWIAYIYYSGSTYYNPSL KSRVTISVDTSKNQFSLKLSSVTAADTAVYYCA RMTTPYWYFDLWGRGTLVTVSSASTKGPSVFP |

TABLE 1B-continued

Exemplary Antibody Heavy Chain Sequences

| Contained in Clone | Designation | SEQ ID NO: | Amino Acid Sequence |
|---|---|---|---|
| | | | LAPCSRSTSESTAALGCLVKDYFPEPVTVSWNS GALTSGVHTFPAVLQSSGLYSLSSVVTVPSSNF GTQTYTCNVDHKPSNTKVDKTVERKCCVECPP CPAPPVAGPSVFLFPPKPKDTLMISRTPEVTCVV VDVSHEDPEVQFNWYVDGVEVHNAKTKPREE QFNSTFRVVSVLTVVHQDWLNGKEYKCKVSN KGLPAPIEKTISKTKGQPREPQVYTLPPSREEMT KNQVSLTCLVKGFYPSDIAVEWESNGQPENNY KTTPPMLDSDGSFFLYSKLTVDKSRWQQGNVF SCSVMHEALHNHYTQKSLSLSPGK |
| 64E6 65E8 65F11 67G7 | H2 | 136 | QVQLQESGPGLVKPSQTLSLTCPVSGGSISSGD YYWTWIRQHPGKGLEWIAYIYYTGSTYYNPSL KSRVTISVDTSKNQFSLKLSSVTAADTAVYYCA RMTTPYWYFDLWGRGTLVTVSSASTKGPSVFP LAPCSRSTSESTAALGCLVKDYFPEPVTVSWNS GALTSGVHTFPAVLQSSGLYSLSSVVTVPSSNF GTQTYTCNVDHKPSNTKVDKTVERKCCVECPP CPAPPVAGPSVFLFPPKPKDTLMISRTPEVTCVV VDVSHEDPEVQFNWYVDGVEVHNAKTKPREE QFNSTFRVVSVLTVVHQDWLNGKEYKCKVSN KGLPAPIEKTISKTKGQPREPQVYTLPPSREEMT KNQVSLTCLVKGFYPSDIAVEWESNGQPENNY KTTPPMLDSDGSFFLYSKLTVDKSRWQQGNVF SCSVMHEALHNHYTQKSLSLSPGK |
| 65C1 | H15 | 137 | QVQLQESGPGLVKPSQTLSLTCPVSGGSISSGD YYWTWIRQHPGKGLEWIAYIFYSGSTYYNPSL KSRVTISLDTSKNQFSLKLNSVTAADTAVYYC ARMTSPYWYFDLWGRGTLVTVSSASTKGPSVF PLAPCSRSTSESTAALGCLVKDYFPEPVTVSWN SGALTSGVHTFPAVLQSSGLYSLSSVVTVPSSN FGTQTYTCNVDHKPSNTKVDKTVERKCCVECP PCPAPPVAGPSVFLFPPKPKDTLMISRTPEVTCV VVDVSHEDPEVQFNWYVDGVEVHNAKTKPRE EQFNSTFRVVSVLTVVHQDWLNGKEYKCKVS NKGLPAPIEKTISKTKGQPREPQVYTLPPSREEM TKNQVSLTCLVKGFYPSDIAVEWESNGQPENN YKTTPPMLDSDGSFFLYSKLTVDKSRWQQGNV FSCSVMHEALHNHYTQKSLSLSPGK |
| 66F6 | H14 | 138 | QVQLQESGPGLVKPSQTLSLTCPVSGGSISSGD YYWTWIRHHPGKGLEWIAYIYYSGSTYYNPSL KSRVTISVDTSKNQFSLKLNSVTAADTAVYYC ARMTTPYWYFDLWGRGTLVTVSSASTKGPSVF PLAPCSRSTSESTAALGCLVKDYFPEPVTVSWN SGALTSGVHTFPAVLQSSGLYSLSSVVTVPSSN FGTQTYTCNVDHKPSNTKVDKTVERKCCVECP PCPAPPVAGPSVFLFPPKPKDTLMISRTPEVTCV VVDVSHEDPEVQFNWYVDGVEVHNAKTKPRE EQFNSTFRVVSVLTVVHQDWLNGKEYKCKVS NKGLPAPIEKTISKTKGQPREPQVYTLPPSREEM TKNQVSLTCLVKGFYPSDIAVEWESNGQPENN YKTTPPMLDSDGSFFLYSKLTVDKSRWQQGNV FSCSVMHEALHNHYTQKSLSLSPGK |
| 64A6 | H29 | 139 | QVQLQESGPGLVKPSQTLSLTCTVSGGSISSGG YYWSWIRQRPGKGLEWVGYIYYSGGTHYNPS LKSRVTISIDTSENQFSLKLSSVTAADTAVYYC ARVLHYSDSRGYSYYSDFWGQGTLVTVSSAST KGPSVFPLAPCSRSTSESTAALGCLVKDYFPEP VTVSWNSGALTSGVHTFPAVLQSSGLYSLSSV VTVPSSNFGTQTYTCNVDHKPSNTKVDKTVER KCCVECPPCPAPPVAGPSVFLFPPKPKDTLMISR TPEVTCVVVDVSHEDPEVQFNWYVDGVEVHN AKTKPREEQFNSTFRVVSVLTVVHQDWLNGKE YKCKVSNKGLPAPIEKTISKTKGQPREPQVYTL PPSREEMTKNQVSLTCLVKGFYPSDIAVEWESN GQPENNYKTTPPMLDSDGSFFLYSKLTVDKSR WQQGNVFSCSVMHEALHNHYTQKSLSLSPGK |
| 65F9 | H30 | 140 | QVQLQESGPGLVKPSQTLSLTCTLSGGSFSSGD YYWSWIRQHPGKGLEWIGYIYYSGSTYYNPSL KSRVTISIDTSKNQFSLKLTSVTAADTAVYYCA |

TABLE 1B-continued

Exemplary Antibody Heavy Chain Sequences

| Contained in Clone | Designation | SEQ ID NO: | Amino Acid Sequence |
|---|---|---|---|
| | | | RVLHYYDSSGYSYYFDYWGQGTLVTVSSAST KGPSVFPLAPCSRSTSESTAALGCLVKDYFPEP VTVSWNSGALTSGVHTFPAVLQSSGLYSLSSV VTVPSSNFGTQTYTCNVDHKPSNTKVDKTVER KCCVECPPCPAPPVAGPSVFLFPPKPKDTLMISR TPEVTCVVVDVSHEDPEVQFNWYVDGVEVHN AKTKPREEQFNSTFRVVSVLTVVHQDWLNGKE YKCKVSNKGLPAPIEKTISKTKGQPREPQVYTL PPSREEMTKNQVSLTCLVKGFYPSDIAVEWESN GQPENNYKTTPPMLDSDGSFFLYSKLTVDKSR WQQGNVFSCSVMHEALHNHYTQKSLSLSPGK |
| 64A7 | H16 | 141 | QLQLQESGPGLVKPSETLSLTCTVSGGSISSDTS YWGWIRQPPGKGLEWIGNIYYSGTTYFNPSLK SRVSVSVDTSKNQFSLKLSSVTAADTAVFYCA RLRGVYWYFDLWGRGTLVTVSSASTKGPSVFP LAPCSRSTSESTAALGCLVKDYFPEPVTVSWNS GALTSGVHTFPAVLQSSGLYSLSSVVTVPSSNF GTQTYTCNVDHKPSNTKVDKTVERKCCVECPP CPAPPVAGPSVFLFPPKPKDTLMISRTPEVTCVV VDVSHEDPEVQFNWYVDGVEVHNAKTKPREE QFNSTFRVVSVLTVVHQDWLNGKEYKCKVSN KGLPAPIEKTISKTKGQPREPQVYTLPPSREEMT KNQVSLTCLVKGFYPSDIAVEWESNGQPENNY KTTPPMLDSDGSFFLYSKLTVDKSRWQQGNVF SCSVMHEALHNHYTQKSLSLSPGK |
| 65C3 68D5 | H5 | 142 | QVQLQESGPGLVKPSETLSLTCTVSGGSISSYY WSWIRQPPGKGLEWIGYIYYTGSTNYNPSLKSR VTISVDTSKNQFSLKLSSVTAADTAVYYCARE YYYGSGSYYPWGQGTLVTVSSASTKGPSVFPL APCSRSTSESTAALGCLVKDYFPEPVTVSWNSG ALTSGVHTFPAVLQSSGLYSLSSVVTVPSSNFG TQTYTCNVDHKPSNTKVDKTVERKCCVECPPC PAPPVAGPSVFLFPPKPKDTLMISRTPEVTCVV VDVSHEDPEVQFNWYVDGVEVHNAKTKPREE QFNSTFRVVSVLTVVHQDWLNGKEYKCKVSN KGLPAPIEKTISKTKGQPREPQVYTLPPSREEMT KNQVSLTCLVKGFYPSDIAVEWESNGQPENNY KTTPPMLDSDGSFFLYSKLTVDKSRWQQGNVF SCSVMHEALHNHYTQKSLSLSPGK |
| 67F5 | H31 | 143 | QVQLKESGPGLVKPSETLSLTCTVSGGSISSYY WSWIRQPPGKGLEWIGYIYYSGNTNYNPSLKS RVTISVDTSKNQFSLKLSSVTAADTAVYYCARE YYYGSGSYYPWGQGTLVTVSSASTKGPSVFPL APCSRSTSESTAALGCLVKDYFPEPVTVSWNSG ALTSGVHTFPAVLQSSGLYSLSSVVTVPSSNFG TQTYTCNVDHKPSNTKVDKTVERKCCVECPPC PAPPVAGPSVFLFPPKPKDTLMISRTPEVTCVV VDVSHEDPEVQFNWYVDGVEVHNAKTKPREE QFNSTFRVVSVLTVVHQDWLNGKEYKCKVSN KGLPAPIEKTISKTKGQPREPQVYTLPPSREEMT KNQVSLTCLVKGFYPSDIAVEWESNGQPENNY KTTPPMLDSDGSFFLYSKLTVDKSRWQQGNVF SCSVMHEALHNHYTQKSLSLSPGK |
| 64B10v1 | H32 | 144 | QIQLLESGPGLVKPSETLSLTCTVSGGSVSSGDY YWSWIRQPPGKGLEWIGFIYYSGGTNYNPSLKS RVTISIDTSKNQFSLKLNSVTAADTAVYYCARY SSTWDYYYGVDVWGQGTTVTVSSASTKGPSV FPLAPCSRSTSESTAALGCLVKDYFPEPVTVSW NSGALTSGVHTFPAVLQSSGLYSLSSVVTVPSS NFGTQTYTCNVDHKPSNTKVDKTVERKCCVE CPPCPAPPVAGPSVFLFPPKPKDTLMISRTPEVT CVVVDVSHEDPEVQFNWYVDGVEVHNAKTKP REEQFNSTFRVVSVLTVVHQDWLNGKEYKCK VSNKGLPAPIEKTISKTKGQPREPQVYTLPPSRE EMTKNQVSLTCLVKGFYPSDIAVEWESNGQPE NNYKTTPPMLDSDGSFFLYSKLTVDKSRWQQG NVFSCSVMHEALHNHYTQKSLSLSPGK |
| 64B10v2 | H96 | 1845 | QVQLLESGPGLVKPSETLSLTCTVSGGSVSSGD YYWSWIRQPPGKGLEWIGFIYYSGGTNYNPPL |

TABLE 1B-continued

Exemplary Antibody Heavy Chain Sequences

| Contained in Clone | Designation | SEQ ID NO: | Amino Acid Sequence |
|---|---|---|---|
| | | | KSRVTISIDTSKNQFSLKLSSVTAADTAVYYCA RYSSTWDYYYGVDVWGQGTTVTVSSASTKGP SVFPLAPCSRSTSESTAALGCLVKDYFPEPVTVS WNSGALTSGVHTFPAVLQSSGLYSLSSVVTVPS SNFGTQTYTCNVDHKPSNTKVDKTVERKCCVE CPPCPAPPVAGPSVFLFPPKPKDTLMISRTPEVT CVVVDVSHEDPEVQFNWYVDGVEVHNAKTKP REEQFNSTFRVVSVLTVVHQDWLNGKEYKCK VSNKGLPAPIEKTISKTKGQPREPQVYTLPPSRE EMTKNQVSLTCLVKGFYPSDIAVEWESNGQPE NNYKTTPPMLDSDGSFFLYSKLTVDKSRWQQG NVFSCSVMHEALHNHYTQKSLSLSPGK |
| 68C8 | H33 | 145 | QVQLQESGPGLVKPSETLSLTCTVSGDSVSSGD NYWSWIRQPPGKGLEWIGFMFYSGSTNYNPSL KSRVTISLHTSKNQFSLRLSSVTAADTAVYYCG RYRSDWDYYYGMDVWGQGTTVTVSSASTKG PSVFPLAPCSRSTSESTAALGCLVKDYFPEPVTV SWNSGALTSGVHTFPAVLQSSGLYSLSSVVTVP SSNFGTQTYTCNVDHKPSNTKVDKTVERKCCV ECPPCPAPPVAGPSVFLFPPKPKDTLMISRTPEV TCVVVDVSHEDPEVQFNWYVDGVEVHNAKTK PREEQFNSTFRVVSVLTVVHQDWLNGKEYKC KVSNKGLPAPIEKTISKTKGQPREPQVYTLPPSR EEMTKNQVSLTCLVKGFYPSDIAVEWESNGQP ENNYKTTPPMLDSDGSFFLYSKLTVDKSRWQQ GNVFSCSVMHEALHNHYTQKSLSLSPGK |
| 67A5 | H34 | 146 | EVQLVQSGAEVKKPGESLKISCKGSGYSFTSY WIGWVRQMPGKGLEWMGIIYPGDSDTRYSPSF QGQVTISADKSINTAYLQWSSLKASDTAIYFCA RRASRGYRFGLAFAIWGQGTMVTVSSASTKGP SVFPLAPCSRSTSESTAALGCLVKDYFPEPVTVS WNSGALTSGVHTFPAVLQSSGLYSLSSVVTVPS SNFGTQTYTCNVDHKPSNTKVDKTVERKCCVE CPPCPAPPVAGPSVFLFPPKPKDTLMISRTPEVT CVVVDVSHEDPEVQFNWYVDGVEVHNAKTKP REEQFNSTFRVVSVLTVVHQDWLNGKEYKCK VSNKGLPAPIEKTISKTKGQPREPQVYTLPPSRE EMTKNQVSLTCLVKGFYPSDIAVEWESNGQPE NNYKTTPPMLDSDGSFFLYSKLTVDKSRWQQG NVFSCSVMHEALHNHYTQKSLSLSPGK |
| 67C10 | H35 | 147 | EVQLVQSGAEVKKPGESLKISCQGSGYSFSSY WIGWVRQMPGKGLEWMGIIYPGDSDTRYSPSF QGQVTISADKSINTAYLQWSSLKASDTAIYYCA RRASRGYRYGLAFAIWGQGTMVTVSSASTKGP SVFPLAPCSRSTSESTAALGCLVKDYFPEPVTVS WNSGALTSGVHTFPAVLQSSGLYSLSSVVTVPS SNFGTQTYTCNVDHKPSNTKVDKTVERKCCVE CPPCPAPPVAGPSVFLFPPKPKDTLMISRTPEVT CVVVDVSHEDPEVQFNWYVDGVEVHNAKTKP REEQFNSTFRVVSVLTVVHQDWLNGKEYKCK VSNKGLPAPIEKTISKTKGQPREPQVYTLPPSRE EMTKNQVSLTCLVKGFYPSDIAVEWESNGQPE NNYKTTPPMLDSDGSFFLYSKLTVDKSRWQQG NVFSCSVMHEALHNHYTQKSLSLSPGK |
| 64H6 | H36 | 148 | EVQLVQSGAEVKKPGESLKISCKGSGYSFTSY WIGWVRQMPGKGLEWMGIIYPGDSETRYSPSF QGQVTISADKSISTAYLQWNSLKTSDTAMYFC ATVAVSAFNWFDPWGQGTLVTVSSASTKGPSV FPLAPCSRSTSESTAALGCLVKDYFPEPVTVSW NSGALTSGVHTFPAVLQSSGLYSLSSVVTVPSS NFGTQTYTCNVDHKPSNTKVDKTVERKCCVE CPPCPAPPVAGPSVFLFPPKPKDTLMISRTPEVT CVVVDVSHEDPEVQFNWYVDGVEVHNAKTKP REEQFNSTFRVVSVLTVVHQDWLNGKEYKCK VSNKGLPAPIEKTISKTKGQPREPQVYTLPPSRE EMTKNQVSLTCLVKGFYPSDIAVEWESNGQPE NNYKTTPPMLDSDGSFFLYSKLTVDKSRWQQG NVFSCSVMHEALHNHYTQKSLSLSPGK |

TABLE 1B-continued

Exemplary Antibody Heavy Chain Sequences

| Contained in Clone | Designation | SEQ ID NO: | Amino Acid Sequence |
|---|---|---|---|
| 63F9 | H37 | 149 | QVQLKESGPGLVKPSQTLSLTCTVSGGSISSGG YYWNWIRQHPGKGLEWIGYIYDSGSTYYNPSL KSRVTMSVDTSKNQFSLKLSSVTAADTAVYYC ARDVLMVYTKGGYYYYGVDVWGQGTTVTVS SASTKGPSVFPLAPCSRSTSESTAALGCLVKDY FPEPVTVSWNSGALTSGVHTFPAVLQSSGLYSL SSVVTVPSSNFGTQTYTCNVDHKPSNTKVDKT VERKCCVECPPCPAPPVAGPSVFLFPPKPKDTL MISRTPEVTCVVVDVSHEDPEVQFNWYVDGVE VHNAKTKPREEQFNSTFRVVSVLTVVHQDWL NGKEYKCKVSNKGLPAPIEKTISKTKGQPREPQ VYTLPPSREEMTKNQVSLTCLVKGFYPSDIAVE WESNGQPENNYKTTPPMLDSDGSFFLYSKLTV DKSRWQQGNVFSCSVMHEALHNHYTQKSLSL SPGK |
| 67F6v1 67F6v2 | H38 | 150 | EVQLVQSGAEVKKPGESLKISCKGSGYSFTGY WIGWVRQLPGKGLEWMGIIYPGDSDTRYSPSF QGQVTISVDKSINTAYLQWSSLKASDTAMYYC ARRASRGYSYGHAFDFWGQGTMVTVSSASTK GPSVFPLAPCSRSTSESTAALGCLVKDYFPEPVT VSWNSGALTSGVHTFPAVLQSSGLYSLSSVVT VPSSNFGTQTYTCNVDHKPSNTKVDKTVERKC CVECPPCPAPPVAGPSVFLFPPKPKDTLMISRTP EVTCVVVDVSHEDPEVQFNWYVDGVEVHNAK TKPREEQFNSTFRVVSVLTVVHQDWLNGKEYK CKVSNKGLPAPIEKTISKTKGQPREPQVYTLPPS REEMTKNQVSLTCLVKGFYPSDIAVEWESNGQ PENNYKTTPPMLDSDGSFFLYSKLTVDKSRWQ QGNVFSCSVMHEALHNHYTQKSLSLSPGK |
| 48C9 49A12 51E2 | H73 | 151 | QVQLQQWGAGLLKPSETLSLTCSVYGGSFSGY YWTWIRQPPGKGLEWIGEINHSENTNYNPSLKS RVTISIDTSKNQFSLKLSSVTAADTAVYYCARE SGNFPFDYWGQGTLVTVSSASTKGPSVFPLAPC SRSTSESTAALGCLVKDYFPEPVTVSWNSGALT SGVHTFPAVLQSSGLYSLSSVVTVPSSNFGTQT YTCNVDHKPSNTKVDKTVERKCCVECPPCPAP PVAGPSVFLFPPKPKDTLMISRTPEVTCVVVDV SHEDPEVQFNWYVDGVEVHNAKTKPREEQFN STFRVVSVLTVVHQDWLNGKEYKCKVSNKGL PAPIEKTISKTKGQPREPQVYTLPPSREEMTKNQ VSLTCLVKGFYPSDIAVEWESNGQPENNYKTT PPMLDSDGSFFLYSKLTVDKSRWQQGNVFSCS VMHEALHNHYTQKSLSLSPGK |
| 48F3 | H72 | 152 | QVQLQQWGAGPLKPSETLSLTCAVYGGSISGY YWSWIRQPPGKGLEWIGEITHTGSSNYNPSLKS RVTISVDTSKNQFSLKLSSVTAADTAVYYCAR GGILWFGEQAFDIWGQGTMVTVSSASTKGPSV FPLAPCSRSTSESTAALGCLVKDYFPEPVTVSW NSGALTSGVHTFPAVLQSSGLYSLSSVVTVPSS NFGTQTYTCNVDHKPSNTKVDKTVERKCCVE CPPCPAPPVAGPSVFLFPPKPKDTLMISRTPEVT CVVVDVSHEDPEVQFNWYVDGVEVHNAKTKP REEQFNSTFRVVSVLTVVHQDWLNGKEYKCK VSNKGLPAPIEKTISKTKGQPREPQVYTLPPSRE EMTKNQVSLTCLVKGFYPSDIAVEWESNGQPE NNYKTTPPMLDSDGSFFLYSKLTVDKSRWQQG NVFSCSVMHEALHNHYTQKSLSLSPGK |
| 48F8 53B9 56B4 57E7 57F11 | H48 | 153 | EVQLVESGGGLVKPGGSLRLSCTASGFTFRSYS MNWVRQAPGKGLEWVSSISSSSSYEYYVDSVK GRFTISRDIAKSSLWLQMNSLRAEDTAVYYCA RSLSIAVAASDYWGKGTLVTVSSASTKGPSVFP LAPCSRSTSESTAALGCLVKDYFPEPVTVSWNS GALTSGVHTFPAVLQSSGLYSLSSVVTVPSSNF GTQTYTCNVDHKPSNTKVDKTVERKCCVECPP CPAPPVAGPSVFLFPPKPKDTLMISRTPEVTCVV VDVSHEDPEVQFNWYVDGVEVHNAKTKPREE QFNSTFRVVSVLTVVHQDWLNGKEYKCKVSN KGLPAPIEKTISKTKGQPREPQVYTLPPSREEMT |

TABLE 1B-continued

Exemplary Antibody Heavy Chain Sequences

| Contained in Clone | Designation | SEQ ID NO: | Amino Acid Sequence |
|---|---|---|---|
| | | | KNQVSLTCLVKGFYPSDIAVEWESNGQPENNY KTTPPMLDSDGSFFLYSKLTVDKSRWQQGNVF SCSVMHEALHNHYTQKSLSLSPGK |
| 48H11 | H39 | 154 | QVQLVQSGAEVKKPGASVKVSCKASGYTFTG YYKHWVRQAPGQGLEWMGWINPNSGATKYA QKFQGRVTMTRDTSISTVYMELSRLRSVDTAL YYCAREVPDGIVVAGSNAFDFWGQGTMVTVS SASTKGPSVFPLAPCSRSTSESTAALGCLVKDY FPEPVTVSWNSGALTSGVHTFPAVLQSSGLYSL SSVVTVPSSNFGTQTYTCNVDHKPSNTKVDKT VERKCCVECPPCPAPPVAGPSVFLFPPKPKDTL MISRTPEVTCVVVDVSHEDPEVQFNWYVDGVE VHNAKTKPREEQFNSTFRVVSVLTVVHQDWL NGKEYKCKVSNKGLPAPIEKTISKTKGQPREPQ VYTLPPSREEMTKNQVSLTCLVKGFYPSDIAVE WESNGQPENNYKTTPPMLDSDGSFFLYSKLTV DKSRWQQGNVFSCSVMHEALHNHYTQKSLSL SPGK |
| 49A10 48D4 | H62 | 155 | QVHLVESGGGVVQPGRSLRLSCAASGFTFSNY GMHWVRQAPGKGLEWVAIIWYDGSNKNYAD SVKGRFTISRDNSKNTLYLEMNSLRAEDTAVY YCARDQDYDFWSGYPYFYYYGMDVWGQGTT VTVSSASTKGPSVFPLAPCSRSTSESTAALGCLV KDYFPEPVTVSWNSGALTSGVHTFPAVLQSSG LYSLSSVVTVPSSNFGTQTYTCNVDHKPSNTKV DKTVERKCCVECPPCPAPPVAGPSVFLFPPKPK DTLMISRTPEVTCVVVDVSHEDPEVQFNWYVD GVEVHNAKTKPREEQFNSTFRVVSVLTVVHQD WLNGKEYKCKVSNKGLPAPIEKTISKTKGQPR EPQVYTLPPSREEMTKNQVSLTCLVKGFYPSDI AVEWESNGQPENNYKTTPPMLDSDGSFFLYSK LTVDKSRWQQGNVFSCSVMHEALHNHYTQKS LSLSPGK |
| 49C8 52H1 | H44 | 156 | QVQLVQSGAEVKKPGASVKVSCKASGYTFTSY DIDWVRQATGQGLEWMGWMNPNGGNTGYA QKFQGRVTMTRNTSINTAYMELSSLRSEDTAIY YCARGKEFSRAEFDYWGQGTLVTVSSASTKGP SVFPLAPCSRSTSESTAALGCLVKDYFPEPVTVS WNSGALTSGVHTFPAVLQSSGLYSLSSVVTVPS SNFGTQTYTCNVDHKPSNTKVDKTVERKCCVE CPPCPAPPVAGPSVFLFPPKPKDTLMISRTPEVT CVVVDVSHEDPEVQFNWYVDGVEVHNAKTKP REEQFNSTFRVVSVLTVVHQDWLNGKEYKCK VSNKGLPAPIEKTISKTKGQPREPQVYTLPPSRE EMTKNQVSLTCLVKGFYPSDIAVEWESNGQPE NNYKTTPPMLDSDGSFFLYSKLTVDKSRWQQG NVFSCSVMHEALHNHYTQKSLSLSPGK |
| 49G2 50C12 55G11 | H63 | 157 | QVQLVESGGGVVQPGRSLRLSCAASGFTFSNY GMRWVRQAPGKGLEWVALIWYDGSNKFYAD SVKGRFTISRDNSKNTLNLQMNSLRAEDTAVY YCARDRYYDFWSGYPYFFYYGLDVWGQGTTV TVSSASTKGPSVFPLAPCSRSTSESTAALGCLVK DYFPEPVTVSWNSGALTSGVHTFPAVLQSSGL YSLSSVVTVPSSNFGTQTYTCNVDHKPSNTKV DKTVERKCCVECPPCPAPPVAGPSVFLFPPKPK DTLMISRTPEVTCVVVDVSHEDPEVQFNWYVD GVEVHNAKTKPREEQFNSTFRVVSVLTVVHQD WLNGKEYKCKVSNKGLPAPIEKTISKTKGQPR EPQVYTLPPSREEMTKNQVSLTCLVKGFYPSDI AVEWESNGQPENNYKTTPPMLDSDGSFFLYSK LTVDKSRWQQGNVFSCSVMHEALHNHYTQKS LSLSPGK |
| 49G3 | H46 | 158 | QVTLKESGPVLVKPTETLTLTCTVSGFSLSNPR MGVSWIRQPPGKALEWLTHIFSNDEKSYSTSLK SRLTISKDTSKSQVVLSMTNMDPVDTATYYCV RVDTLNYHYYGMDVWGQGTTVTVSSASTKGP SVFPLAPCSRSTSESTAALGCLVKDYFPEPVTVS WNSGALTSGVHTFPAVLQSSGLYSLSSVVTVPS SNFGTQTYTCNVDHKPSNTKVDKTVERKCCVE |

TABLE 1B-continued

Exemplary Antibody Heavy Chain Sequences

| Contained in Clone | Designation | SEQ ID NO: | Amino Acid Sequence |
|---|---|---|---|
| | | | CPPCPAPPVAGPSVFLFPPKPKDTLMISRTPEVT CVVVDVSHEDPEVQFNWYVDGVEVHNAKTKP REEQFNSTFRVVSVLTVVHQDWLNGKEYKCK VSNKGLPAPIEKTISKTKGQPREPQVYTLPPSRE EMTKNQVSLTCLVKGFYPSDIAVEWESNGQPE NNYKTTPPMLDSDGSFFLYSKLTVDKSRWQQG NVFSCSVMHEALHNHYTQKSLSLSPGK |
| 49H12 | H42 | 159 | QVQLVQSGAEVKKPGASVKVSCMASGYIFTSY DINWVRQATGQGPEWMGWMNPYSGSTGYAQ NFQGRVTMTRNTSINTAYMELSSLRSEDTAVY YCAKYNWNYGAFDFWGQGTMVTVSSASTKG PSVFPLAPCSRSTSESTAALGCLVKDYFPEPVTV SWNSGALTSGVHTFPAVLQSSGLYSLSSVVTVP SSNFGTQTYTCNVDHKPSNTKVDKTVERKCCV ECPPCPAPPVAGPSVFLFPPKPKDTLMISRTPEV TCVVVDVSHEDPEVQFNWYVDGVEVHNAKTK PREEQFNSTFRVVSVLTVVHQDWLNGKEYKC KVSNKGLPAPIEKTISKTKGQPREPQVYTLPPSR EEMTKNQVSLTCLVKGFYPSDIAVEWESNGQP ENNYKTTPPMLDSDGSFFLYSKLTVDKSRWQQ GNVFSCSVMHEALHNHYTQKSLSLSPGK |
| 51A8 | H58 | 160 | QVQLVESGGGVVQPGRSLRLSCAASGFTFSSY GMHWVRQAPGKGLEWVAVISYDGSNKYYAD SVKGRFTISRDNSKNTLYLQMNSLRAEDTAVY YCARADGDYPYYYYYGMDVWGQGTTVTVS SASTKGPSVFPLAPCSRSTSESTAALGCLVKDY FPEPVTVSWNSGALTSGVHTFPAVLQSSGLYSL SSVVTVPSSNFGTQTYTCNVDHKPSNTKVDKT VERKCCVECPPCPAPPVAGPSVFLFPPKPKDTL MISRTPEVTCVVVDVSHEDPEVQFNWYVDGVE VHNAKTKPREEQFNSTFRVVSVLTVVHQDWL NGKEYKCKVSNKGLPAPIEKTISKTKGQPREPQ VYTLPPSREEMTKNQVSLTCLVKGFYPSDIAVE WESNGQPENNYKTTPPMLDSDGSFFLYSKLTV DKSRWQQGNVFSCSVMHEALHNHYTQKSLSL SPGK |
| 51C10.2 | H67 | 161 | QVQLQESGPGLVKPSQTLSLTCTVSGGSISSGG YYWSWIRQHPGKGLEWIGYIYYNGSPYDNPSL KRRVTISIDASKNQFSLKLSSMTAADTAVYYCA RGALYGMDVWGQGTTVTVSSASTKGPSVFPL APCSRSTSESTAALGCLVKDYFPEPVTVSWNSG ALTSGVHTFPAVLQSSGLYSLSSVVTVPSSNFG TQTYTCNVDHKPSNTKVDKTVERKCCVECPPC PAPPVAGPSVFLFPPKPKDTLMISRTPEVTCVV VDVSHEDPEVQFNWYVDGVEVHNAKTKPREE QFNSTFRVVSVLTVVHQDWLNGKEYKCKVSN KGLPAPIEKTISKTKGQPREPQVYTLPPSREEMT KNQVSLTCLVKGFYPSDIAVEWESNGQPENNY KTTPPMLDSDGSFFLYSKLTVDKSRWQQGNVF SCSVMHEALHNHYTQKSLSLSPGK |
| 51E5 | H74 | 162 | QVQLQQWGAGLLKPSETLSLTCAVYGGSFSGY YWSWIRQPPGKGLEWIGELDHSGSINYNPSLKS RVTISVDTSKNQFSLKLTSVTAADTAVYYCAR VLGSTLDYWGQGTLVTVSSASTKGPSVFPLAP CSRSTSESTAALGCLVKDYFPEPVTVSWNSGAL TSGVHTFPAVLQSSGLYSLSSVVTVPSSNFGTQ TYTCNVDHKPSNTKVDKTVERKCCVECPPCPA PPVAGPSVFLFPPKPKDTLMISRTPEVTCVVVD VSHEDPEVQFNWYVDGVEVHNAKTKPREEQF NSTFRVVSVLTVVHQDWLNGKEYKCKVSNKG LPAPIEKTISKTKGQPREPQVYTLPPSREEMTKN QVSLTCLVKGFYPSDIAVEWESNGQPENNYKT TPPMLDSDGSFFLYSKLTVDKSRWQQGNVFSC SVMHEALHNHYTQKSLSLSPGK |
| 51G2 | H50 | 163 | EVQLVESGGGLVKPGGSLRLSCAASGFTFSSYS MNWVRQAPGKGLEWVSSISSSSTYIYYADSVK GRFTISRDNAKNSLYLQMNSLRAEDTAVYYCA RDTYISGWNYGMDVWGQGTTVTVSSASTKGP SVFPLAPCSRSTSESTAALGCLVKDYFPEPVTVS |

TABLE 1B-continued

Exemplary Antibody Heavy Chain Sequences

| Contained in Clone | Designation | SEQ ID NO: | Amino Acid Sequence |
|---|---|---|---|
| | | | WNSGALTSGVHTFPAVLQSSGLYSLSSVVTVPS SNFGTQTYTCNVDHKPSNTKVDKTVERKCCVE CPPCPAPPVAGPSVFLFPPKPKDTLMISRTPEVT CVVVDVSHEDPEVQFNWYVDGVEVHNAKTKP REEQFNSTFRVVSVLTVVHQDWLNGKEYKCK VSNKGLPAPIEKTISKTKGQPREPQVYTLPPSRE EMTKNQVSLTCLVKGFYPSDIAVEWESNGQPE NNYKTTPPMLDSDGSFFLYSKLTVDKSRWQQG NVFSCSVMHEALHNHYTQKSLSLSPGK |
| 52A8 | H40 | 164 | QVQLVQSGAEVKKPGASVKVSCKASGYTFTG YYLHWVRQAPGQGLEWMGWINPNSAATNYA PKFQGRVTVTRDTSISTAYMELSRLRSDDTAVY YCAREGGTYNWFDPWGQGTLVTVSSASTKGP SVFPLAPCSRSTSESTAALGCLVKDYFPEPVTVS WNSGALTSGVHTFPAVLQSSGLYSLSSVVTVPS SNFGTQTYTCNVDHKPSNTKVDKTVERKCCVE CPPCPAPPVAGPSVFLFPPKPKDTLMISRTPEVT CVVVDVSHEDPEVQFNWYVDGVEVHNAKTKP REEQFNSTFRVVSVLTVVHQDWLNGKEYKCK VSNKGLPAPIEKTISKTKGQPREPQVYTLPPSRE EMTKNQVSLTCLVKGFYPSDIAVEWESNGQPE NNYKTTPPMLDSDGSFFLYSKLTVDKSRWQQG NVFSCSVMHEALHNHYTQKSLSLSPGK |
| 52B8 | H77 | 165 | QVQLQESGPGLMKPSETLSLTCTVSGGSISYYY WSWIRQSPGKGLEWIGYIYYSGSTNYNPSLKSR VTMSVDTSKNQFSLKLSSVTAADTAVYYCASG TRAFDIWGQGTMVTVSSASTKGPSVFPLAPCSR STSESTAALGCLVKDYFPEPVTVSWNSGALTSG VHTFPAVLQSSGLYSLSSVVTVPSSNFGTQTYT CNVDHKPSNTKVDKTVERKCCVECPPCPAPPV AGPSVFLFPPKPKDTLMISRTPEVTCVVVDVSH EDPEVQFNWYVDGVEVHNAKTKPREEQFNSTF RVVSVLTVVHQDWLNGKEYKCKVSNKGLPAP IEKTISKTKGQPREPQVYTLPPSREEMTKNQVS LTCLVKGFYPSDIAVEWESNGQPENNYKTTPP MLDSDGSFFLYSKLTVDKSRWQQGNVFSCSV MHEALHNHYTQKSLSLSPGK |
| 52C1 | H64 | 166 | QVQLVESGGGVVQPGRSLRLSCAASGFTFSSY GMHWVRQAPGKGLEWVAVIWYDGSNNYYAD SVKGRFTISRDNSKSTLFLQMNSLRAEDTAIYY CARDRAGASPGMDVWGQGTTVTVSSASTKGP SVFPLAPCSRSTSESTAALGCLVKDYFPEPVTVS WNSGALTSGVHTFPAVLQSSGLYSLSSVVTVPS SNFGTQTYTCNVDHKPSNTKVDKTVERKCCVE CPPCPAPPVAGPSVFLFPPKPKDTLMISRTPEVT CVVVDVSHEDPEVQFNWYVDGVEVHNAKTKP REEQFNSTFRVVSVLTVVHQDWLNGKEYKCK VSNKGLPAPIEKTISKTKGQPREPQVYTLPPSRE EMTKNQVSLTCLVKGFYPSDIAVEWESNGQPE NNYKTTPPMLDSDGSFFLYSKLTVDKSRWQQG NVFSCSVMHEALHNHYTQKSLSLSPGK |
| 52F8 | H41 | 167 | QVQLVQSGAEVKKPGASVKVSCKASGFTFIGY YTHWVRQAPGQGLEWMGWINPSSGDTKYAQ KFQGRVTLARDTSISTAYMELSRLRSDDTAVY YCANSGWYPSYYYGMDVWGQGTTVTVSSAST KGPSVFPLAPCSRSTSESTAALGCLVKDYFPEP VTVSWNSGALTSGVHTFPAVLQSSGLYSLSSV VTVPSSNFGTQTYTCNVDHKPSNTKVDKTVER KCCVECPPCPAPPVAGPSVFLFPPKPKDTLMISR TPEVTCVVVDVSHEDPEVQFNWYVDGVEVHN AKTKPREEQFNSTFRVVSVLTVVHQDWLNGKE YKCKVSNKGLPAPIEKTISKTKGQPREPQVYTL PPSREEMTKNQVSLTCLVKGFYPSDIAVEWESN GQPENNYKTTPPMLDSDGSFFLYSKLTVDKSR WQQGNVFSCSVMHEALHNHYTQKSLSLSPGK |
| 52H2 | H79 | 168 | QVQLQESGPGLVKPSETLSLTCTVSGGSISTYY WSWIRQPPGTGLEWIGYIFYNGNANYSPSLKSR VTFSVDTSKNQFSLKLSSVTAADTAVYFCARET |

TABLE 1B-continued

Exemplary Antibody Heavy Chain Sequences

| Contained in Clone | Designation | SEQ ID NO: | Amino Acid Sequence |
|---|---|---|---|
| | | | DYGDYARPFEYWGQGTLVTVSSASTKGPSVFP LAPCSRSTSESTAALGCLVKDYFPEPVTVSWNS GALTSGVHTFPAVLQSSGLYSLSSVVTVPSSNF GTQTYTCNVDHKPSNTKVDKTVERKCCVECPP CPAPPVAGPSVFLFPPKPKDTLMISRTPEVTCVV VDVSHEDPEVQFNWYVDGVEVHNAKTKPREE QFNSTFRVVSVLTVVHQDWLNGKEYKCKVSN KGLPAPIEKTISKTKGQPREPQVYTLPPSREEMT KNQVSLTCLVKGFYPSDIAVEWESNGQPENNY KTTPPMLDSDGSFFLYSKLTVDKSRWQQGNVF SCSVMHEALHNHYTQKSLSLSPGK |
| 53F6 | H60 | 169 | QVQLVESGGGVVQPGRSLRLSCAASGFTFSTY GMHWVRQAPGKGLEWVAVIWYDGSNKYYAD SVKGRFTISRDNSKNTLYLQMNSLRAEDTAVY YCARGHYDSSGPRDYWGQGTLVTVSSASTKG PSVFPLAPCSRSTSESTAALGCLVKDYFPEPVTV SWNSGALTSGVHTFPAVLQSSGLYSLSSVVTVP SSNFGTQTYTCNVDHKPSNTKVDKTVERKCCV ECPPCPAPPVAGPSVFLFPPKPKDTLMISRTPEV TCVVVDVSHEDPEVQFNWYVDGVEVHNAKTK PREEQFNSTFRVVSVLTVVHQDWLNGKEYKC KVSNKGLPAPIEKTISKTKGQPREPQVYTLPPSR EEMTKNQVSLTCLVKGFYPSDIAVEWESNGQP ENNYKTTPPMLDSDGSFFLYSKLTVDKSRWQQ GNVFSCSVMHEALHNHYTQKSLSLSPGK |
| 53H5.2 | H59 | 170 | QVQLVESGGGVVQPGRSLRLSCAASGFTFSSY GMHWVRQAPGQGLEWVALISYDGSNKYYAD SVKGRFTISRDKSKNTLYLQMNSLRAEDTAVY YCAREANWGYNYYGMDVWGQGTTVTVSSAS TKGPSVFPLAPCSRSTSESTAALGCLVKDYFPEP VTVSWNSGALTSGVHTFPAVLQSSGLYSLSSV VTVPSSNFGTQTYTCNVDHKPSNTKVDKTVER KCCVECPPCPAPPVAGPSVFLFPPKPKDTLMISR TPEVTCVVVDVSHEDPEVQFNWYVDGVEVHN AKTKPREEQFNSTFRVVSVLTVVHQDWLNGKE YKCKVSNKGLPAPIEKTISKTKGQPREPQVYTL PPSREEMTKNQVSLTCLVKGFYPSDIAVEWESN GQPENNYKTTPPMLDSDGSFFLYSKLTVDKSR WQQGNVFSCSVMHEALHNHYTQKSLSLSPGK |
| 53H5.3 | H75 | 171 | QVQLQQWGAGLLKPSETLSLTCAVYGGSFSDY YWNWIRQPPGKGPEWIGEINHSGTTNYNPSLK SRVTISVDTSKNQFSLKLSSVTAADTAVYYCVG ILRYFDWLEYYFDYWGQGTLVTVSSASTKGPS VFPLAPCSRSTSESTAALGCLVKDYFPEPVTVS WNSGALTSGVHTFPAVLQSSGLYSLSSVVTVPS SNFGTQTYTCNVDHKPSNTKVDKTVERKCCVE CPPCPAPPVAGPSVFLFPPKPKDTLMISRTPEVT CVVVDVSHEDPEVQFNWYVDGVEVHNAKTKP REEQFNSTFRVVSVLTVVHQDWLNGKEYKCK VSNKGLPAPIEKTISKTKGQPREPQVYTLPPSRE EMTKNQVSLTCLVKGFYPSDIAVEWESNGQPE NNYKTTPPMLDSDGSFFLYSKLTVDKSRWQQG NVFSCSVMHEALHNHYTQKSLSLSPGK |
| 54A1 55G9 | H43 | 172 | QVQLVQSGAEVKKPGASVKVSCKASGYTFTSY DINWVRQATGQGLEWMGWMNPHSGNTGYAQ KFQGRVTMTRNTSINTAYMELSSLRSEDTAVY YCAKYNWNYGAFDFWGQGTMVTVSSASTKG PSVFPLAPCSRSTSESTAALGCLVKDYFPEPVTV SWNSGALTSGVHTFPAVLQSSGLYSLSSVVTVP SSNFGTQTYTCNVDHKPSNTKVDKTVERKCCV ECPPCPAPPVAGPSVFLFPPKPKDTLMISRTPEV TCVVVDVSHEDPEVQFNWYVDGVEVHNAKTK PREEQFNSTFRVVSVLTVVHQDWLNGKEYKC KVSNKGLPAPIEKTISKTKGQPREPQVYTLPPSR EEMTKNQVSLTCLVKGFYPSDIAVEWESNGQP ENNYKTTPPMLDSDGSFFLYSKLTVDKSRWQQ GNVFSCSVMHEALHNHYTQKSLSLSPGK |

TABLE 1B-continued

Exemplary Antibody Heavy Chain Sequences

| Contained in Clone | Designation | SEQ ID NO: | Amino Acid Sequence |
|---|---|---|---|
| 54H10.1<br>55D1<br>48H3<br>53C11 | H52 | 173 | EVQLLESGGGLVQPGGSLRLSCAASGFTFSSYA<br>MSWVRQAPGKGLEWVSAISGSGRTTYSADSV<br>KGRFTISRDNSKNTLYLQMNSLRAEDTAVYYC<br>AKEQQWLVYFDYWGQGTLVTVSSASTKGPSV<br>FPLAPCSRSTSESTAALGCLVKDYFPEPVTVSW<br>NSGALTSGVHTFPAVLQSSGLYSLSSVVTVPSS<br>NFGTQTYTCNVDHKPSNTKVDKTVERKCCVE<br>CPPCPAPPVAGPSVFLFPPKPKDTLMISRTPEVT<br>CVVVDVSHEDPEVQFNWYVDGVEVHNAKTKP<br>REEQFNSTFRVVSVLTVVHQDWLNGKEYKCK<br>VSNKGLPAPIEKTISKTKGQPREPQVYTLPPSRE<br>EMTKNQVSLTCLVKGFYPSDIAVEWESNGQPE<br>NNYKTTPPMLDSDGSFFLYSKLTVDKSRWQQG<br>NVFSCSVMHEALHNHYTQKSLSLSPGK |
| 55D3 | H68 | 174 | QVQLQESGPGLVKPSQTLSLTCTVSGGSITSGV<br>YYWNWIRQHPGKGLEWIGYLYYSGSTYYNPS<br>LKSRLTISADMSKNQFSLKLSSVTVADTAVYY<br>CARDGITMVRGVTHYYGMDVWGQGTTVTVSS<br>ASTKGPSVFPLAPCSRSTSESTAALGCLVKDYF<br>PEPVTVSWNSGALTSGVHTFPAVLQSSGLYSLS<br>SVVTVPSSNFGTQTYTCNVDHKPSNTKVDKTV<br>ERKCCVECPPCPAPPVAGPSVFLFPPKPKDTLMI<br>SRTPEVTCVVVDVSHEDPEVQFNWYVDGVEV<br>HNAKTKPREEQFNSTFRVVSVLTVVHQDWLN<br>GKEYKCKVSNKGLPAPIEKTISKTKGQPREPQV<br>YTLPPSREEMTKNQVSLTCLVKGFYPSDIAVE<br>WESNGQPENNYKTTPPMLDSDGSFFLYSKLTV<br>DKSRWQQGNVFSCSVMHEALHNHYTQKSLSL<br>SPGK |
| 55E4<br>52C5<br>60G5.1<br>49B11<br>50H10<br>53C1 | H70 | 175 | QVQLQQWGAGLLKPSETLSLTCAVYGGSFSGY<br>YWSWIRQPPGKGLEWIGEINHSENTNYNPSLKS<br>RVTISLDTSNDQFSLRLTSVTAADTAVYYCARV<br>TGTDAFDFWGQGTMVTVSSASTKGPSVFPLAP<br>CSRSTSESTAALGCLVKDYFPEPVTVSWNSGAL<br>TSGVHTFPAVLQSSGLYSLSSVVTVPSSNFGTQ<br>TYTCNVDHKPSNTKVDKTVERKCCVECPPCPA<br>PPVAGPSVFLFPPKPKDTLMISRTPEVTCVVVD<br>VSHEDPEVQFNWYVDGVEVHNAKTKPREEQF<br>NSTFRVVSVLTVVHQDWLNGKEYKCKVSNKG<br>LPAPIEKTISKTKGQPREPQVYTLPPSREEMTKN<br>QVSLTCLVKGFYPSDIAVEWESNGQPENNYKT<br>TPPMLDSDGSFFLYSKLTVDKSRWQQGNVFSC<br>SVMHEALHNHYTQKSLSLSPGK |
| 55E9 | H65 | 176 | QVQLVESGGGVVQPGRSLRLSCAASGFTFSSFG<br>MHWVRQAPGKGLEWVALIWYDGDNKYYADS<br>VKGRFTISRDNSKNTLYLQMNSLRAEDTAVYY<br>CARNSGWDYFYYYGMDVWGQGTTVTVSSAS<br>TKGPSVFPLAPCSRSTSESTAALGCLVKDYFPEP<br>VTVSWNSGALTSGVHTFPAVLQSSGLYSLSSV<br>VTVPSSNFGTQTYTCNVDHKPSNTKVDKTVER<br>KCCVECPPCPAPPVAGPSVFLFPPKPKDTLMISR<br>TPEVTCVVVDVSHEDPEVQFNWYVDGVEVHN<br>AKTKPREEQFNSTFRVVSVLTVVHQDWLNGKE<br>YKCKVSNKGLPAPIEKTISKTKGQPREPQVYTL<br>PPSREEMTKNQVSLTCLVKGFYPSDIAVEWESN<br>GQPENNYKTTPPMLDSDGSFFLYSKLTVDKSR<br>WQQGNVFSCSVMHEALHNHYTQKSLSLSPGK |
| 55G5 | H78 | 177 | QVQLQESGPGLVKPSETLSLTCTVSGGSISSYY<br>WSWIRQPAGKGLEWIGRIYISGSTNYNPSLENR<br>VTMSGDTSKNQFSLKLNSVTAADTAVYYCAG<br>SGSYSFDYWGQGTLVTVSSASTKGPSVFPLAPC<br>SRSTSESTAALGCLVKDYFPEPVTVSWNSGALT<br>SGVHTFPAVLQSSGLYSLSSVVTVPSSNFGTQT<br>YTCNVDHKPSNTKVDKTVERKCCVECPPCPAP<br>PVAGPSVFLFPPKPKDTLMISRTPEVTCVVVDV<br>SHEDPEVQFNWYVDGVEVHNAKTKPREEQFN<br>STFRVVSVLTVVHQDWLNGKEYKCKVSNKGL<br>PAPIEKTISKTKGQPREPQVYTLPPSREEMTKNQ |

TABLE 1B-continued

Exemplary Antibody Heavy Chain Sequences

| Contained in Clone | Designation | SEQ ID NO: | Amino Acid Sequence |
|---|---|---|---|
| | | | VSLTCLVKGFYPSDIAVEWESNGQPENNYKTT PPMLDSDGSFFLYSKLTVDKSRWQQGNVFSCS VMHEALHNHYTQKSLSLSPGK |
| 50G1 | H84 | 178 | QVQLVESGGGVVQPGRSLRLSCAASGFTFSSY GLHWVRQAPGKGLEWVAVIWNDGSNKLYAD SVKGRFTISRDNSKNTLYLQMNSLRAEDTAVY YCARDQYYDFWSGYPYYHYYGMDVWGQGTT VTVSSASTKGPSVFPLAPCSRSTSESTAALGCLV KDYFPEPVTVSWNSGALTSGVHTFPAVLQSSG LYSLSSVVTVPSSNFGTQTYTCNVDHKPSNTKV DKTVERKCCVECPPCPAPPVAGPSVFLFPPKPK DTLMISRTPEVTCVVVDVSHEDPEVQFNWYVD GVEVHNAKTKPREEQFNSTFRVVSVLTVVHQD WLNGKEYKCKVSNKGLPAPIEKTISKTKGQPR EPQVYTLPPSREEMTKNQVSLTCLVKGFYPSDI AVEWESNGQPENNYKTTPPMLDSDGSFFLYSK LTVDKSRWQQGNVFSCSVMHEALHNHYTQKS LSLSPGK |
| 56A7 56E4 | H51 | 179 | EVQLVESGGGLVKPGGSLRLSCAASGFTFSSYS MNWVRQAPGKGLEWVSSISSSSTYIYYADSVK GRFTISRDNAKNSLYLQMNSLRAEDTAVYYCA RDIYSSGWSYGMDVWGQGTTVTVSSASTKGPS VFPLAPCSRSTSESTAALGCLVKDYFPEPVTVS WNSGALTSGVHTFPAVLQSSGLYSLSSVVTVPS SNFGTQTYTCNVDHKPSNTKVDKTVERKCCVE CPPCPAPPVAGPSVFLFPPKPKDTLMISRTPEVT CVVVDVSHEDPEVQFNWYVDGVEVHNAKTKP REEQFNSTFRVVSVLTVVHQDWLNGKEYKCK VSNKGLPAPIEKTISKTKGQPREPQVYTLPPSRE EMTKNQVSLTCLVKGFYPSDIAVEWESNGQPE NNYKTTPPMLDSDGSFFLYSKLTVDKSRWQQG NVFSCSVMHEALHNHYTQKSLSLSPGK |
| 56C11 | H61 | 180 | QVQLVESGGGVVQPGRSLRLSCAASGFTFSSY GMHWVRQAPGKGLEWVAVIWYDGSYQFYAD SVKGRFTISRDNSKNTLYLQMNSLRAEDTAVY YCARDHVWRTYRYIFDYWGQGTLVTVSSAST KGPSVFPLAPCSRSTSESTAALGCLVKDYFPEP VTVSWNSGALTSGVHTFPAVLQSSGLYSLSSV VTVPSSNFGTQTYTCNVDHKPSNTKVDKTVER KCCVECPPCPAPPVAGPSVFLFPPKPKDTLMISR TPEVTCVVVDVSHEDPEVQFNWYVDGVEVHN AKTKPREEQFNSTFRVVSVLTVVHQDWLNGKE YKCKVSNKGLPAPIEKTISKTKGQPREPQVYTL PPSREEMTKNQVSLTCLVKGFYPSDIAVEWESN GQPENNYKTTPPMLDSDGSFFLYSKLTVDKSR WQQGNVFSCSVMHEALHNHYTQKSLSLSPGK |
| 56E7 | H81 | 181 | EVQLVQSGPEVKKPGESLKISCKGSGYSLTSYW IGWVRQMPGKGLEWMGIIYPGDSDTRYSPSFQ GQVTISADTSISTAYLQWSRLKASDTAVYYCA RAQLGIFDYWGQGTLVTVSSASTKGPSVFPLAP CSRSTSESTAALGCLVKDYFPEPVTVSWNSGAL TSGVHTFPAVLQSSGLYSLSSVVTVPSSNFGTQ TYTCNVDHKPSNTKVDKTVERKCCVECPPCPA PPVAGPSVFLFPPKPKDTLMISRTPEVTCVVVD VSHEDPEVQFNWYVDGVEVHNAKTKPREEQF NSTFRVVSVLTVVHQDWLNGKEYKCKVSNKG LPAPIEKTISKTKGQPREPQVYTLPPSREEMTKN QVSLTCLVKGFYPSDIAVEWESNGQPENNYKT TPPMLDSDGSFFLYSKLTVDKSRWQQGNVFSC SVMHEALHNHYTQKSLSLSPGK |
| 56G1 | H71 | 182 | QVQLQQWGAGLLKPSETLSLTCAVYGGSFSGY YWSWIRQPPGKGLEWIGEINHSENTNYNPSLKS RVTISLDTSNKQFSLRLTSVTAADTAVYYCARV TGTDAFDFWGQGTMVTVSSASTKGPSVFPLAP CSRSTSESTAALGCLVKDYFPEPVTVSWNSGAL TSGVHTFPAVLQSSGLYSLSSVVTVPSSNFGTQ TYTCNVDHKPSNTKVDKTVERKCCVECPPCPA PPVAGPSVFLFPPKPKDTLMISRTPEVTCVVVD VSHEDPEVQFNWYVDGVEVHNAKTKPREEQF |

TABLE 1B-continued

Exemplary Antibody Heavy Chain Sequences

| Contained in Clone | Designation | SEQ ID NO: | Amino Acid Sequence |
|---|---|---|---|
| | | | NSTFRVVSVLTVVHQDWLNGKEYKCKVSNKG LPAPIEKTISKTKGQPREPQVYTLPPSREEMTKN QVSLTCLVKGFYPSDIAVEWESNGQPENNYKT TPPMLDSDGSFFLYSKLTVDKSRWQQGNVFSC SVMHEALHNHYTQKSLSLSPGK |
| 56G3.3 55B10 | H76 | 183 | QLQLQESGPGLVKPSETLSLTCTVSGDSISSSSY YWGWIRQPPGKGLEWIGMIYYSGTTYYNPSLK SRVTISVDTSKNQFSLKLSSVTAADTAVYYCAR VAAVYWYFDLWGRGTLVTVSSASTKGPSVFPL APCSRSTSESTAALGCLVKDYFPEPVTVSWNSG ALTSGVHTFPAVLQSSGLYSLSSVVTVPSSNFG TQTYTCNVDHKPSNTKVDKTVERKCCVECPPC PAPPVAGPSVFLFPPKPKDTLMISRTPEVTCVV VDVSHEDPEVQFNWYVDGVEVHNAKTKPREE QFNSTFRVVSVLTVVHQDWLNGKEYKCKVSN KGLPAPIEKTISKTKGQPREPQVYTLPPSREEMT KNQVSLTCLVKGFYPSDIAVEWESNGQPENNY KTTPPMLDSDGSFFLYSKLTVDKSRWQQGNVF SCSVMHEALHNHYTQKSLSLSPGK |
| 57B12 | H69 | 184 | QVQLQESGPGLVKPSQTLSLTCTVSGGSITSGV YYWSWIRQLPGKGLEWIGYIYYSGSTYYNPSL KSRLTISADTSKNQFSLKLSSVTVADTAVYYCA RDGITMVRGVTHYYGMDVWGQGTTVTVSSAS TKGPSVFPLAPCSRSTSESTAALGCLVKDYFPEP VTVSWNSGALTSGVHTFPAVLQSSGLYSLSSV VTVPSSNFGTQTYTCNVDHKPSNTKVDKTVER KCCVECPPCPAPPVAGPSVFLFPPKPKDTLMISR TPEVTCVVVDVSHEDPEVQFNWYVDGVEVHN AKTKPREEQFNSTFRVVSVLTVVHQDWLNGKE YKCKVSNKGLPAPIEKTISKTKGQPREPQVYTL PPSREEMTKNQVSLTCLVKGFYPSDIAVEWESN GQPENNYKTTPPMLDSDGSFFLYSKLTVDKSR WQQGNVFSCSVMHEALHNHYTQKSLSLSPGK |
| 57D9 | H82 | 185 | QVQLQQSGPGLVKPSQTLSLTCAISGDSVSSNS ATWNWIRQSPSRGLEWLGRTYYRSKWYNDYA VSVKSRITINPDTSKNQFSLQLNSVTPEDTAVY YCVGIVVVPAVLFDYWGQGTLVTVSSASTKGP SVFPLAPCSRSTSESTAALGCLVKDYFPEPVTVS WNSGALTSGVHTFPAVLQSSGLYSLSSVVTVPS SNFGTQTYTCNVDHKPSNTKVDKTVERKCCVE CPPCPAPPVAGPSVFLFPPKPKDTLMISRTPEVT CVVVDVSHEDPEVQFNWYVDGVEVHNAKTKP REEQFNSTFRVVSVLTVVHQDWLNGKEYKCK VSNKGLPAPIEKTISKTKGQPREPQVYTLPPSRE EMTKNQVSLTCLVKGFYPSDIAVEWESNGQPE NNYKTTPPMLDSDGSFFLYSKLTVDKSRWQQG NVFSCSVMHEALHNHYTQKSLSLSPGK |
| 58C2 | H85 | 186 | QVQLVESGGGVVQPGRSLRLSCAASGFTFSNY GMHWVRQAPGKGLEWVAVIWNDGNNKYYA DSVKGRFTISRDNSKNTLYLQMNSLRAEDTAV YYCARDQNYDFWNGYPYYFYYGMDVWGQG TTVTVSSASTKGPSVFPLAPCSRSTSESTAALGC LVKDYFPEPVTVSWNSGALTSGVHTFPAVLQS SGLYSLSSVVTVPSSNFGTQTYTCNVDHKPSNT KVDKTVERKCCVECPPCPAPPVAGPSVFLFPPK PKDTLMISRTPEVTCVVVDVSHEDPEVQFNWY VDGVEVHNAKTKPREEQFNSTFRVVSVLTVVH QDWLNGKEYKCKVSNKGLPAPIEKTISKTKGQ PREPQVYTLPPSREEMTKNQVSLTCLVKGFYPS DIAVEWESNGQPENNYKTTPPMLDSDGSFFLY SKLTVDKSRWQQGNVFSCSVMHEALHNHYTQ KSLSLSPGK |
| 59A10 49H4 | H47 | 187 | QVQVVESGGGLVKPGGSLRLSCAASGFTFSDS YMSWIRQAPGKGLEWISSISSSGSIVYFADSVK GRFTISRDIAKNSLYLHMNSLRAEDTAVYYCA RETFSSGWFDAFDIWGQGTMVTVSSASTKGPS VFPLAPCSRSTSESTAALGCLVKDYFPEPVTVS WNSGALTSGVHTFPAVLQSSGLYSLSSVVTVPS SNFGTQTYTCNVDHKPSNTKVDKTVERKCCVE |

TABLE 1B-continued

Exemplary Antibody Heavy Chain Sequences

| Contained in Clone | Designation | SEQ ID NO: | Amino Acid Sequence |
|---|---|---|---|
| | | | CPPCPAPPVAGPSVFLFPPKPKDTLMISRTPEVT CVVVDVSHEDPEVQFNWYVDGVEVHNAKTKP REEQFNSTFRVVSVLTVVHQDWLNGKEYKCK VSNKGLPAPIEKTISKTKGQPREPQVYTLPPSRE EMTKNQVSLTCLVKGFYPSDIAVEWESNGQPE NNYKTTPPMLDSDGSFFLYSKLTVDKSRWQQG NVFSCSVMHEALHNHYTQKSLSLSPGK |
| 59C9 58A5 57A4 57F9 | H49 | 188 | EVQLVESGGGLVKPGGSLRLSCAASGFTFSSYS MSWVRQAPGKGLEWVSSISSSSTYIYYADSLK GRFTISRDNAKNSLFLQVNSLRAEDSAVYYCA RDRWSSGWNEGFDYWGQGTLVTVSSASTKGP SVFPLAPCSRSTSESTAALGCLVKDYFPEPVTVS WNSGALTSGVHTFPAVLQSSGLYSLSSVVTVPS SNFGTQTYTCNVDHKPSNTKVDKTVERKCCVE CPPCPAPPVAGPSVFLFPPKPKDTLMISRTPEVT CVVVDVSHEDPEVQFNWYVDGVEVHNAKTKP REEQFNSTFRVVSVLTVVHQDWLNGKEYKCK VSNKGLPAPIEKTISKTKGQPREPQVYTLPPSRE EMTKNQVSLTCLVKGFYPSDIAVEWESNGQPE NNYKTTPPMLDSDGSFFLYSKLTVDKSRWQQG NVFSCSVMHEALHNHYTQKSLSLSPGK |
| 59G10.2 | H57 | 189 | QVQLVESGGGVVQPGRSLRLSCAASGFTFSNY GMHWVRQAPGKGLEWVAITSYGGSNKNYAD SVKGRFTISRDNSKNTLYLQMNSLRAEDTAVY YCAREAGYSFDYWGQGTLVTVSSASTKGPSVF PLAPCSRSTSESTAALGCLVKDYFPEPVTVSWN SGALTSGVHTFPAVLQSSGLYSLSSVVTVPSSN FGTQTYTCNVDHKPSNTKVDKTVERKCCVECP PCPAPPVAGPSVFLFPPKPKDTLMISRTPEVTCV VVDVSHEDPEVQFNWYVDGVEVHNAKTKPRE EQFNSTFRVVSVLTVVHQDWLNGKEYKCKVS NKGLPAPIEKTISKTKGQPREPQVYTLPPSREEM TKNQVSLTCLVKGFYPSDIAVEWESNGQPENN YKTTPPMLDSDGSFFLYSKLTVDKSRWQQGNV FSCSVMHEALHNHYTQKSLSLSPGK |
| 59G10.3 | H53 | 190 | EVQLLGSGGGLVQPGGSLRLSCAASGFTFNHY AMSWVRQAPGKGLEWVSAISGSGAGTFYADS MKGRFTISRDNSENTLHLQMNSLRAEDTAIYY CAKDLRIAVAGSFDYWGQGTLVTVSSASTKGP SVFPLAPCSRSTSESTAALGCLVKDYFPEPVTVS WNSGALTSGVHTFPAVLQSSGLYSLSSVVTVPS SNFGTQTYTCNVDHKPSNTKVDKTVERKCCVE CPPCPAPPVAGPSVFLFPPKPKDTLMISRTPEVT CVVVDVSHEDPEVQFNWYVDGVEVHNAKTKP REEQFNSTFRVVSVLTVVHQDWLNGKEYKCK VSNKGLPAPIEKTISKTKGQPREPQVYTLPPSRE EMTKNQVSLTCLVKGFYPSDIAVEWESNGQPE NNYKTTPPMLDSDGSFFLYSKLTVDKSRWQQG NVFSCSVMHEALHNHYTQKSLSLSPGK |
| 60D7 | H66 | 191 | QVQLVESGGGVVQPGRSLRLSCAASGFNFSSY GMHWVRQAPGKGLEWVAVIWYDGSNKYYAD SVKGRFTISRDNSKNTLYLQMNSLRAEDTAVF YCARDQYFDFWSGYPFFYYYGMDVWGQGTT VTVSSASTKGPSVFPLAPCSRSTSESTAALGCLV KDYFPEPVTVSWNSGALTSGVHTFPAVLQSSG LYSLSSVVTVPSSNFGTQTYTCNVDHKPSNTKV DKTVERKCCVECPPCPAPPVAGPSVFLFPPKPK DTLMISRTPEVTCVVVDVSHEDPEVQFNWYVD GVEVHNAKTKPREEQFNSTFRVVSVLTVVHQD WLNGKEYKCKVSNKGLPAPIEKTISKTKGQPR EPQVYTLPPSREEMTKNQVSLTCLVKGFYPSDI AVEWESNGQPENNYKTTPPMLDSDGSFFLYSK LTVDKSRWQQGNVFSCSVMHEALHNHYTQKS LSLSPGK |
| 60F9 48B4 52D6 | H55 | 192 | EVQLLESGGGLVQPGGSLRLSCAASGFTFSSYA MSWVRQAPGKGLEWVSVISDSGGSTYYADSV KGRFTISRDNSKNTLYLQMNSLRAEDTAVYYC AKDHSSGWYYYGMDVWGQGTTVTVSSASTK GPSVFPLAPCSRSTSESTAALGCLVKDYFPEPVT |

TABLE 1B-continued

Exemplary Antibody Heavy Chain Sequences

| Contained in Clone | Designation | SEQ ID NO: | Amino Acid Sequence |
|---|---|---|---|
| | | | VSWNSGALTSGVHTFPAVLQSSGLYSLSSVVT VPSSNFGTQTYTCNVDHKPSNTKVDKTVERKC CVECPPCPAPPVAGPSVFLFPPKPKDTLMISRTP EVTCVVVDVSHEDPEVQFNWYVDGVEVHNAK TKPREEQFNSTFRVVSVLTVVHQDWLNGKEYK CKVSNKGLPAPIEKTISKTKGQPREPQVYTLPPS REEMTKNQVSLTCLVKGFYPSDIAVEWESNGQ PENNYKTTPPMLDSDGSFFLYSKLTVDKSRWQ QGNVFSCSVMHEALHNHYTQKSLSLSPGK |
| 60G5.2 | H45 | 193 | QVQLVQSGAEVKTPGASVRVSCKASGYTFTNY GISWVRQAPGQGLEWMGWISAYNGYSNYAQK FQDRVTMTTDTSTSTAYMELRSLRSDDTAVYY CAREEKQLVKDYYYGMDVWGQGSTVTVSS ASTKGPSVFPLAPCSRSTSESTAALGCLVKDYF PEPVTVSWNSGALTSGVHTFPAVLQSSGLYSLS SVVTVPSSNFGTQTYTCNVDHKPSNTKVDKTV ERKCCVECPPCPAPPVAGPSVFLFPPKPKDTLMI SRTPEVTCVVVDVSHEDPEVQFNWYVDGVEV HNAKTKPREEQFNSTFRVVSVLTVVHQDWLN GKEYKCKVSNKGLPAPIEKTISKTKGQPREPQV YTLPPSREEMTKNQVSLTCLVKGFYPSDIAVE WESNGQPENNYKTTPPMLDSDGSFFLYSKLTV DKSRWQQGNVFSCSVMHEALHNHYTQKSLSL SPGK |
| 61G5 | H56 | 194 | EVQLLESGGGLVQPGGSLRLSCAASGFTFSSYA MSWVRQSPGKGLEWVSVISGSGGDTYYADSV KGRFTISRDNSKNTLYLQMNSLRAEDTAVYYC AKDHTSGWYYYGMDVWGQGTTVTVSSASTK GPSVFPLAPCSRSTSESTAALGCLVKDYFPEPVT VSWNSGALTSGVHTFPAVLQSSGLYSLSSVVT VPSSNFGTQTYTCNVDHKPSNTKVDKTVERKC CVECPPCPAPPVAGPSVFLFPPKPKDTLMISRTP EVTCVVVDVSHEDPEVQFNWYVDGVEVHNAK TKPREEQFNSTFRVVSVLTVVHQDWLNGKEYK CKVSNKGLPAPIEKTISKTKGQPREPQVYTLPPS REEMTKNQVSLTCLVKGFYPSDIAVEWESNGQ PENNYKTTPPMLDSDGSFFLYSKLTVDKSRWQ QGNVFSCSVMHEALHNHYTQKSLSLSPGK |
| 59D10v1 59D10v2 51C10.1 | H54 | 195 | EVQLLESGGGLVQPGGSLRLSCAASGFTFRNY AMSWVRQAPGKGLEWVSGISGSSAGTYYADS VKGRFTISRDNSKNTLFLQMDSLRAEDTAVYY CAQDWSIAVAGTFDYWGQGTLVTVSSASTKG PSVFPLAPCSRSTSESTAALGCLVKDYFPEPVTV SWNSGALTSGVHTFPAVLQSSGLYSLSSVVTVP SSNFGTQTYTCNVDHKPSNTKVDKTVERKCCV ECPPCPAPPVAGPSVFLFPPKPKDTLMISRTPEV TCVVVDVSHEDPEVQFNWYVDGVEVHNAKTK PREEQFNSTFRVVSVLTVVHQDWLNGKEYKC KVSNKGLPAPIEKTISKTKGQPREPQVYTLPPSR EEMTKNQVSLTCLVKGFYPSDIAVEWESNGQP ENNYKTTPPMLDSDGSFFLYSKLTVDKSRWQQ GNVFSCSVMHEALHNHYTQKSLSLSPGK |
| 56G3.2 | H80 | 196 | QVQLQESGPGLVKPSETLSLTCTVSDGSISSYY WNWIRQPAGKGLEWIGRIYTSGSTNYNPSLKS RVTMSVDTSKNQFSLNLTSVTAADTAVYYCAR GPLWFDYWGQGTLVTVSSASTKGPSVFPLAPC SRSTSESTAALGCLVKDYFPEPVTVSWNSGALT SGVHTFPAVLQSSGLYSLSSVVTVPSSNFGTQT YTCNVDHKPSNTKVDKTVERKCCVECPPCPAP PVAGPSVFLFPPKPKDTLMISRTPEVTCVVVDV SHEDPEVQFNWYVDGVEVHNAKTKPREEQFN STFRVVSVLTVVHQDWLNGKEYKCKVSNKGL PAPIEKTISKTKGQPREPQVYTLPPSREEMTKNQ VSLTCLVKGFYPSDIAVEWESNGQPENNYKTT PPMLDSDGSFFLYSKLTVDKSRWQQGNVFSCS VMHEALHNHYTQKSLSLSPGK |
| 48G4 53C3.1 | H83 | 197 | QVQLVQSGAEVKKPGASVKVSCKVSGYTLTEL SIHWVRQAPGKGLEWMGGFDPEDGETIYAQKF QGRVTMTEDTSTDTAYMELSSLRSEDTAVYYC |

TABLE 1B-continued

Exemplary Antibody Heavy Chain Sequences

| Contained in Clone | Designation | SEQ ID NO: | Amino Acid Sequence |
|---|---|---|---|
| | | | ATHSGSGRFYYYYYGMDVWGQGTTVTVSSAS TKGPSVFPLAPCSRSTSESTAALGCLVKDYFPEP VTVSWNSGALTSGVHTFPAVLQSSGLYSLSSV VTVPSSNFGTQTYTCNVDHKPSNTKVDKTVER KCCVECPPCPAPPVAGPSVFLFPPKPKDTLMISR TPEVTCVVVDVSHEDPEVQFNWYVDGVEVHN AKTKPREEQFNSTFRVVSVLTVVHQDWLNGKE YKCKVSNKGLPAPIEKTISKTKGQPREPQVYTL PPSREEMTKNQVSLTCLVKGFYPSDIAVEWESN GQPENNYKTTPPMLDSDGSFFLYSKLTVDKSR WQQGNVFSCSVMHEALHNHYTQKSLSLSPGK |
| 61H5 52B9 | H86 | 198 | QLQLQESGPGLVKPSETLSLTCTVSGGSISSSSY YWGWIRQPPGKGLEWIGSIYYSGTTYYNPSLK SRVTISVDTSKNQFSLKLSSVTAADTAVYYCAR VAAVYWYFDLWGRGTLVTVSSASTKGPSVFPL APCSRSTSESTAALGCLVKDYFPEPVTVSWNSG ALTSGVHTFPAVLQSSGLYSLSSVVTVPSSNFG TQTYTCNVDHKPSNTKVDKTVERKCCVECPPC PAPPVAGPSVFLFPPKPKDTLMISRTPEVTCVV VDVSHEDPEVQFNWYVDGVEVHNAKTKPREE QFNSTFRVVSVLTVVHQDWLNGKEYKCKVSN KGLPAPIEKTISKTKGQPREPQVYTLPPSREEMT KNQVSLTCLVKGFYPSDIAVEWESNGQPENNY KTTPPMLDSDGSFFLYSKLTVDKSRWQQGNVF SCSVMHEALHNHYTQKSLSLSPGK |
| 50D4 | H87 | 199 | QVQLVQSGAEVKKTGASVKVSCKASGYTFTSH DINWVRQATGHGLEWMGWMNPYSGSTGLAQ RFQDRVTMTRNTSISTAYMELSSLRSEDTAVY YCARDLSSGYYYYGLDVWGQGTTVTVSSAST KGPSVFPLAPCSRSTSESTAALGCLVKDYFPEP VTVSWNSGALTSGVHTFPAVLQSSGLYSLSSV VTVPSSNFGTQTYTCNVDHKPSNTKVDKTVER KCCVECPPCPAPPVAGPSVFLFPPKPKDTLMISR TPEVTCVVVDVSHEDPEVQFNWYVDGVEVHN AKTKPREEQFNSTFRVVSVLTVVHQDWLNGKE YKCKVSNKGLPAPIEKTISKTKGQPREPQVYTL PPSREEMTKNQVSLTCLVKGFYPSDIAVEWESN GQPENNYKTTPPMLDSDGSFFLYSKLTVDKSR WQQGNVFSCSVMHEALHNHYTQKSLSLSPGK |
| 50G5v1 50G5v2 | H88 | 200 | QVQLVQSGAEVKKPGASVKVSCKASGYPFIGY YMHWVRQAPGQGLEWMGWINPDSGGTNYAQ KFQGRVTMTRDTSITTAYMELSRLRSDDTAVF YCARGGYSYGYEDYYGMDVWGQGTTVTVSS ASTKGPSVFPLAPCSRSTSESTAALGCLVKDYF PEPVTVSWNSGALTSGVHTFPAVLQSSGLYSLS SVVTVPSSNFGTQTYTCNVDHKPSNTKVDKTV ERKCCVECPPCPAPPVAGPSVFLFPPKPKDTLMI SRTPEVTCVVVDVSHEDPEVQFNWYVDGVEV HNAKTKPREEQFNSTFRVVSVLTVVHQDWLN GKEYKCKVSNKGLPAPIEKTISKTKGQPREPQV YTLPPSREEMTKNQVSLTCLVKGFYPSDIAVE WESNGQPENNYKTTPPMLDSDGSFFLYSKLTV DKSRWQQGNVFSCSVMHEALHNHYTQKSLSL SPGK |
| 51C1 | H89 | 201 | QVQLQQWGAGLLKPSETLSLTCAVYGGSFSGY YWSWIRQPPGKGLEWIGEINHSENTNYNPSLKS RVTISLDTSHDQFSLRLTSVTAADTAVYYCARV TGTDAFDFWGQGTMVTVSSASTKGPSVFPLAP CSRSTSESTAALGCLVKDYFPEPVTVSWNSGAL TSGVHTFPAVLQSSGLYSLSSVVTVPSSNFGTQ TYTCNVDHKPSNTKVDKTVERKCCVECPPCPA PPVAGPSVFLFPPKPKDTLMISRTPEVTCVVVD VSHEDPEVQFNWYVDGVEVHNAKTKPREEQF NSTFRVVSVLTVVHQDWLNGKEYKCKVSNKG LPAPIEKTISKTKGQPREPQVYTLPPSREEMTKN QVSLTCLVKGFYPSDIAVEWESNGQPENNYKT TPPMLDSDGSFFLYSKLTVDKSRWQQGNVFSC SVMHEALHNHYTQKSLSLSPGK |

TABLE 1B-continued

Exemplary Antibody Heavy Chain Sequences

| Contained in Clone | Designation | SEQ ID NO: | Amino Acid Sequence |
| --- | --- | --- | --- |
| 53C3.2 | H90 | 202 | QVQLQESGPGLVKPSQTLSLTCTVSNGSINSGN YYWSWIRQHPGKGLEWIGYIYHSGSAYYNPSL KSRVTISVDTSKNQFSLKLSSVTAADTAVYYCA RTTGASDIWGQGIMVTVSSASTKGPSVFPLAPC SRSTSESTAALGCLVKDYFPEPVTVSWNSGALT SGVHTFPAVLQSSGLYSLSSVVTVPSSNFGTQT YTCNVDHKPSNTKVDKTVERKCCVECPPCPAP PVAGPSVFLFPPKPKDTLMISRTPEVTCVVVDV SHEDPEVQFNWYVDGVEVHNAKTKPREEQFN STFRVVSVLTVVHQDWLNGKEYKCKVSNKGL PAPIEKTISKTKGQPREPQVYTLPPSREEMTKNQ VSLTCLVKGFYPSDIAVEWESNGQPENNYKTT PPMLDSDGSFFLYSKLTVDKSRWQQGNVFSCS VMHEALHNHYTQKSLSLSPGK |
| 54H10.3 | H91 | 203 | QVQVVQSGTEVKKPGASVKVSCKASGYTFTG YYIHWVRQAPGQGLEWMGWINPNSGGTNYA QKFRGRVTMTRDTSISTAYMELSRLRSDDTAV YYCAREEDYSDHHYFDYWGQGTLVTVSSAST KGPSVFPLAPCSRSTSESTAALGCLVKDYFPEP VTVSWNSGALTSGVHTFPAVLQSSGLYSLSSV VTVPSSNFGTQTYTCNVDHKPSNTKVDKTVER KCCVECPPCPAPPVAGPSVFLFPPKPKDTLMISR TPEVTCVVVDVSHEDPEVQFNWYVDGVEVHN AKTKPREEQFNSTFRVVSVLTVVHQDWLNGKE YKCKVSNKGLPAPIEKTISKTKGQPREPQVYTL PPSREEMTKNQVSLTCLVKGFYPSDIAVEWESN GQPENNYKTTPPMLDSDGSFFLYSKLTVDKSR WQQGNVFSCSVMHEALHNHYTQKSLSLSPGK |
| 55A7 | H92 | 204 | QVQLQESGPGLVKPSETLSLTCTVSGGSISSYY WSWIRQPPGKGLEWIGYIYYSGSTNYNPSLKSR VTISVDTSKNQFSLRLSSVTAADTAVYYCARGI TGTIDFWGQGTLVTVSSASTKGPSVFPLAPCSR STSESTAALGCLVKDYFPEPVTVSWNSGALTSG VHTFPAVLQSSGLYSLSSVVTVPSSNFGTQTYT CNVDHKPSNTKVDKTVERKCCVECPPCPAPPV AGPSVFLFPPKPKDTLMISRTPEVTCVVVDVSH EDPEVQFNWYVDGVEVHNAKTKPREEQFNSTF RVVSVLTVVHQDWLNGKEYKCKVSNKGLPAP IEKTISKTKGQPREPQVYTLPPSREEMTKNQVS LTCLVKGFYPSDIAVEWESNGQPENNYKTTPP MLDSDGSFFLYSKLTVDKSRWQQGNVFSCSV MHEALHNHYTQKSLSLSPGK |
| 55E6 | H93 | 205 | EVQLVESGGGLVQPGGSLRLSCAASGFTFSSYS MNWVRQAPGKGLEWISYISSGSSTIYHADSVK GRFTISRDNAKNSLYLQMNSLRDEDTAVYYCA REGYYDSSGYYYNGMDVWGQGTTVTVSSAST KGPSVFPLAPCSRSTSESTAALGCLVKDYFPEP VTVSWNSGALTSGVHTFPAVLQSSGLYSLSSV VTVPSSNFGTQTYTCNVDHKPSNTKVDKTVER KCCVECPPCPAPPVAGPSVFLFPPKPKDTLMISR TPEVTCVVVDVSHEDPEVQFNWYVDGVEVHN AKTKPREEQFNSTFRVVSVLTVVHQDWLNGKE YKCKVSNKGLPAPIEKTISKTKGQPREPQVYTL PPSREEMTKNQVSLTCLVKGFYPSDIAVEWESN GQPENNYKTTPPMLDSDGSFFLYSKLTVDKSR WQQGNVFSCSVMHEALHNHYTQKSLSLSPGK |
| 61E1 | H94 | 206 | QVQLQQSGPGLVKPSQTLSLTCAISGDSVSSNS AAWNWIRQSPSRGLEWLGRTYYRSKWYNDY AVSVKSRITITPDTSKNQFSLQLKSVTPEDTAIY YCAREGSWSSFFDYWGQGTLVTVSSASTKGPS VFPLAPCSRSTSESTAALGCLVKDYFPEPVTVS WNSGALTSGVHTFPAVLQSSGLYSLSSVVTVPS SNFGTQTYTCNVDHKPSNTKVDKTVERKCCVE CPPCPAPPVAGPSVFLFPPKPKDTLMISRTPEVT CVVVDVSHEDPEVQFNWYVDGVEVHNAKTKP REEQFNSTFRVVSVLTVVHQDWLNGKEYKCK VSNKGLPAPIEKTISKTKGQPREPQVYTLPPSRE |

TABLE 1B-continued

Exemplary Antibody Heavy Chain Sequences

| Contained in Clone | Designation | SEQ ID NO: | Amino Acid Sequence |
|---|---|---|---|
| | | | EMTKNQVSLTCLVKGFYPSDIAVEWESNGQPE NNYKTTPPMLDSDGSFFLYSKLTVDKSRWQQG NVFSCSVMHEALHNHYTQKSLSLSPGK |

Each of the exemplary heavy chains (H1, H2, H3 etc.) listed in Table 1B, infra, can be combined with any of the exemplary light chains shown in Table 1A, infra, to form an antibody. Examples of such combinations include H1 combined with any of L1 through L100; H2 combined with any of L1 through L100; H3 combined with any of L1 through L100, and so on. In some instances, the antibodies include at least one heavy chain and one light chain from those listed in Tables 1A and 1B, infra; particular examples pairings of light chains and heavy chains include L1 with H1, L2 with H1, L3 with H2 or H3, L4 with H4, L5 with H5, L6 with H6, L7 with H6, L8 with H7 or H8, L9 with H9, L10 with H9, L11 with H10, L12 with H11, L13 with H12, L13 with H14, L14 with H13, L15 with H14, L16 with H15, L17 with H16, L18 with H17, L19 with H18, L20 with H19, L21 with H20, L22 with H21, L23 with H22, L24 with H23, L25 with H24, L26 with H25, L27 with H26, L28 with H27, L29 with H28, L30 with H29, L31 with H30, L32 with H31, L33 with H32, L34 with H33, L35 with H34, L36 with H35, L37 with H36, L38 with H37, L39 with H38, L40 with H39, L41 with H40, L42 with H41, L43 with H42, L44 with H43, L45 with H44, L46 with H45, L47 with H46, L48 with H47, L49 with H48, L50 with H49, L51 with H50, L52 with H51, L53 with H52, L54 with H53, L55 with H54, and L56 with H54, L57 with H54, L58 with H55, L59 with H56, L60 with H57, L61 with H58, L62 with H59, L63 with H60, L64 with H1, L65 with H62, L66 with H63, L67 with H64, L68 with H65, L69 with H66, L70 with H67, L71 with H68, L72 with H69, L73 with H70, L74 with H70, and L75 with H70, L76 with H71, L77 with H72, L78 with H73, L79 with H74, L80 with H75, L81 with H76, L82 with H77, L83 with H78, L84 with H79, L85 with H80, L86 with H81, L87 with H82, L88 with H86, L89 with H83, L90 with H84, L91 with H85, L92 with H87, L93 with H88, L94 with H88, L95 with H89, L96 with H90, L97 with H91, L98 with H92, L99 with H93, and L100 with H94. In addition to antigen binding proteins comprising a heavy and a light chain from the same clone, a heavy chain from a first clone can be paired with a light chain from a second clone (e.g., a heavy chain from a first clone paired with a light chain from a second clone or a heavy chain from a first clone paired with a light chain from a second clone). Generally, such pairings can include VL with 90% or greater homology can be paired with the heavy chain of the naturally occurring clone.

In some instances, the antibodies comprise two different heavy chains and two different light chains listed in Tables 1A and 1B, infra. In other instances, the antibodies contain two identical light chains and two identical heavy chains. As an example, an antibody or immunologically functional fragment can include two L1 light chains with two H1 heavy chains, two L2 light chains with two H1 heavy chains, two L3 light chains with two H2 heavy chains or two H3 heavy chains, two L4 light chains with two H4 heavy chains, two L5 light chains with two H5 heavy chains, two L6 light chains with two H6 heavy chains, two L7 light chains with two H6 heavy chains, two L8 light chains with two H7 heavy chains or two H8 heavy chains, two L9 light chains with two H9 heavy chains, two L10 light chains with two H9 heavy chains, two L11 light chains with two H10 heavy chains, two L12 light chains with two H11 heavy chains, two L13 light chains with two H12 heavy chains, two L13 light chains with two H14 heavy chains, two L14 light chains with two H13 heavy chains, two L15 light chains with two H14 heavy chains, two L16 light chains with two H15 heavy chains, two L17 light chains with two H16 heavy chains, two L18 light chains with two H17 heavy chains, two L19 light chains with two H18 heavy chains, two L20 light chains with two H19 heavy chains, two L21 light chains with two H20 heavy chains, two L22 light chains with two H21 heavy chains, two L23 light chains with two H22 heavy chains, two L24 light chains with two H23 heavy chains, two L25 light chains with two H24 heavy chains, two L26 light chains with two H25 heavy chains, two L27 light chains with two H26 heavy chains, two L28 light chains with two H27 heavy chains, two L29 light chains with two H28 heavy chains, two L30 light chains with two H29 heavy chains, two L31 light chains with two H30 heavy chains, two L32 light chains with two H31 heavy chains, two L33 light chains with two H32 heavy chains, two L34 light chains with two H33 heavy chains, two L35 chains with two H34 heavy chains, two L36 chains with two H35 heavy chains, two L37 light chains with two H36 heavy chains, two L38 light chains with two H37 heavy chains, two L39 light chains with two H38 heavy chains, two L40 light chains with two H39 heavy chains, two L41 light chains with two H40 heavy chains, two L42 light chains with two H41 heavy chains, two L43 light chains with two H42 heavy chains, two L44 light chains with two H43 heavy chains, two L45 light chains with two H44 heavy chains, two L46 light chains with two H45 heavy chains, two L47 light chains with two H46 heavy chains, two L48 light chains with two H47 heavy chains, two L49 light chains with two H48 heavy chains, two L50 light chains with two H49 heavy chains, two L51 light chains with two H50 heavy chains, two L52 light chains with two H51 heavy chains, two L53 light chains with two H52 heavy chains, two L54 light chains with two H53 heavy chains, two L55 light chains with two H54 heavy chains, and two L56 light chains with two H54 heavy chains, two L57 light chains with two H54 heavy chains, two L58 light chains with two H55 heavy chains, two L59 light chains with two H56 heavy chains, two L60 light chains with two H57 heavy chains, two L61 light chains with two H58 heavy chains, two L62 light chains with two H59 heavy chains, two L63 light chains with two H60 heavy chains, two L64 light chains with two H1 heavy chains, two L65 light chains with two H62 heavy chains, two L66 light chains with two H63 heavy chains, two L67 light chains with two H64 heavy chains, two L68 light chains with two H65 heavy chains, two L69 light chains with two H66 heavy chains, two L70 light chains with two H67 heavy chains, two L71 light chains with two H68 heavy chains, two L72 light chains with two H69 heavy chains, two L73 light chains with two H70 heavy chains, two L74 light chains with two H70 heavy chains, and two L75 light chains with two H70 heavy chains, two L76 light chains with two H71 heavy chains, two L77 light chains with two H72 heavy chains, two L78 light chains with two H73 heavy chains, two L79 light chains with two H74 heavy chains, two L80 light chains with two H75 heavy chains, two L81 light chains with two H76 heavy chains, two L82 light chains with two H77 heavy chains, two L83 light chains with two H78 heavy chains, two L84 light chains with two H79 heavy chains, two L85 light chains with two H80 heavy chains, two L86 light chains with two H81 heavy chains, two L87 light chains with two H82 heavy chains, two L88 light chains with two H86 heavy chains, two L89 light chains with two H83 heavy chains, two L90 light chains with two H84 heavy chains, two L91 light chains with two H85 heavy chains, two L92 light chains with two H87 heavy chains, two L93 light chains with two H88 heavy chains, two L94 light chains with two H88 heavy chains, two L95 light chains with two H89 heavy chains, two L96 light chains with two H90 heavy chains, two L97 light chains with two H91 heavy chains, two L98 light chains with two H92 heavy chains, two L99 light chains with two H93 heavy chains, and two L100 light chains with two H94 heavy chains, as well as other similar combinations of pairs comprising the light chains and pairs of heavy chains as listed in Tables 1A and 1B, infra.

In another aspect of the instant disclosure, "hemibodies" are provided. A hemibody is a monovalent antigen binding protein comprising (i) an intact light chain, and (ii) a heavy chain fused to an Fc region (e.g., an IgG2 Fc region of SEQ ID NO: 11), optionally via a linker, The linker can be a $(G_4S)_x$ linker (SEQ ID NO: 207) where "x" is a non-zero integer (e.g., $(G_4S)_2$, $(G_4S)_3$, $(G_4S)_4$, $(G_4S)_5$, $(G_4S)_6$, $(G_4S)_7$, $(G_4S)_8$, $(G_4S)_9$, $(G_4S)_{10}$; SEQ ID NOS: 208-216, respectively). Hemibodies can be constructed using the provided heavy and light chain components.

Other antigen binding proteins that are provided are variants of antibodies formed by combination of the heavy and light chains shown in Tables 1A and 1B, infra and comprise light and/or heavy chains that each have at least 70%, 75%, 80%, 85%, 90%, 95%, 96%, 97%, 98% or 99% identity to the amino acid sequences of these chains. In some instances, such antibodies include at least one heavy chain and one light chain, whereas in other instances the variant forms contain two identical light chains and two identical heavy chains.

Variable Domains of Antigen Binding Proteins

Also provided are antigen binding proteins that contain an antibody heavy chain variable region selected from the group consisting of $V_H1$, $V_H2$, $V_H3$, $V_H4$, $V_H5$, $V_H6$, $V_H7$, $V_H8$, $V_H9$, $V_H10$, $V_H11$, $V_H12$, $V_H13$, $V_H14$, $V_H15$, $V_H16$, $V_H17$, $V_H18$, $V_H19$, $V_H20$, $V_H21$, $V_H22$, $V_H23$, $V_H24$, $V_H25$, $V_H26$, $V_H27$, $V_H28$, $V_H29$, $V_H30$, $V_H31$, $V_H32$, $V_H33$, $V_H34$, $V_H35$, $V_H36$, $V_H37$, $V_H38$, $V_H39$, $V_H40$, $V_H41$, $V_H42$, $V_H43$, $V_H44$, $V_H45$, $V_H46$, $V_H47$, $V_H48$, $V_H49$, $V_H50$, $V_H51$, $V_H52$, $V_H53$, $V_H54$, $V_H55$, $V_H56$, $V_H57$, $V_H58$, $V_H59$, $V_H60$, $V_H61$, $V_H62$, $V_H63$, $V_H64$, $V_H65$, $V_H66$, $V_H67$, $V_H68$, $V_H69$, $V_H70$, $V_H71$, $V_H72$, $V_H73$, $V_H74$, $V_H75$, $V_H76$, $V_H77$, $V_H78$, $V_H79$, $V_H80$, 81, $V_H82$, $V_H83$, $V_H84$, $V_H85$, $V_H86$, $V_H87$, $V_H88$, $V_H89$, $V_H90$, $V_H91$, $V_H92$, $V_H93$, and $V_H94$ as shown in Table 2B and/or an antibody light chain variable region selected from the group consisting of $V_L1$, $V_L2$, $V_L3$, $V_L4$, $V_L5$, $V_L6$, $V_L7$, $V_L8$, $V_L9$, $V_L10$, $V_L11$, $V_L12$, $V_L13$, $V_L14$, $V_L15$, $V_L16$, $V_L17$, $V_L18$, $V_L19$, $V_L20$, $V_L21$, $V_L22$, $V_L23$, $V_L24$, $V_L25$, $V_L26$, $V_L27$, $V_L28$, $V_L29$, $V_L30$, $V_L31$, $V_L32$, $V_L33$, $V_L34$, $V_L35$, $V_L36$, $V_L37$, $V_L38$, $V_L39$, $V_L40$, $V_L41$, $V_L42$, $V_L43$, $V_L44$, $V_L45$, $V_L46$, $V_L47$, $V_L48$, $V_L49$, $V_L50$, $V_L51$, $V_L52$, $V_L53$, $V_L54$, $V_L55$, $V_L56$, $V_L57$, $V_L58$, $V_L59$, $V_L60$, $V_L61$, $V_L62$, $V_L63$, $V_L64$, $V_L65$, $V_L66$, $V_L67$, $V_L68$, $V_L69$, $V_L70$, $V_L71$, $V_L72$, $V_L73$, $V_L74$, $V_L75$, $V_L76$, $V_L77$, $V_L78$, $V_L79$, $V_L80$, $V_L81$, $V_L82$, $V_L83$, $V_L84$, $V_L85$, $V_L86$, $V_L87$, $V_L88$, $V_L89$, $V_L90$, $V_L91$, $V_L92$, $V_L93$, $V_L94$, $V_L95$, $V_L96$, $V_L97$, $V_L98$, $V_L99$ and $V_L100$ as shown in Table 2A, and immunologically functional fragments, derivatives, muteins and variants of these light chain and heavy chain variable regions.

TABLE 2A

Exemplary Antibody Variable Light ($V_L$) Chains

| Contained in Clone | Designation | SEQ ID NO. | Amino Acid Sequence |
|---|---|---|---|
| 63E6 | $V_L6$ | 217 | DIQMTQSPSSLSASVGDRVTITCRTSQSISSYLNWY QQKPGKAPNLLIYAASSLQSGVPSRFSGSGSGTDFT LTISGLQPEDFSTYYCQQSYSTSLTFGGGTKVEIKR |
| 66F7 | $V_L7$ | 218 | DIQMTQSPSSLSASVGDRVTITCRTSQSISNYLNWY QQKPGKAPNLLIYAASSLQSGVPSRFSGSGSGTDFT LTISGLQPEDFSTYYCQQSYSTSLTFGGGTKVEIKR |
| 66D4 | $V_L18$ | 219 | DIQMTQSPSSLSASVGDRITITCRASQIISRYLNWY QQNPGKAPKLLISAASSLQSGVPSRFSGSGSGPDFT LTISSLQPEDFTTYYCQQSYSSPLTFGGGTKVEVKR |
| 66B4 | $V_L11$ | 220 | DIQMTQSPSSVSSSVGDRVTITCRASQGISRWLAW YQQKPGKAPKLLIYAASSLKSGVPSRFSGSGSGTD FTLTISSLQPEDFATYYCQQANSFPPTFGQGTKVEI KR |
| 65B1 | $V_L19$ | 221 | DIQMTQSPSSLSASVGDRVTITCRASQNINNYLNW YRQKPGKAPELLIYTTSSLQSGVPSRFSGSGSGTDF TLTISSLETEDFETYYCQQSYSTPLTFGGGTKVEIKR |
| 65B4 | $V_L21$ | 222 | SYVLTQPPSVSVAPGQTARITCGGNNIGSKSVQWY QQKPGQAPVLVVYDDSDRPSGIPERFSGSNSGNTA SLTISRVEAGDEADYYCQVWDSSSDHVVFGGGTK LTVLG |

TABLE 2A-continued

Exemplary Antibody Variable Light (V$_L$) Chains

| Contained in Clone | Designation | SEQ ID NO. | Amino Acid Sequence |
|---|---|---|---|
| 67A4 | V$_L$20 | 223 | SYVLTQPPSVSVAPGQTARITCGGNNIGSKSVHWY QQKPGQAPVLVVYDDSDRPSGIPERFSGSNSGNTA TLTISRVEAGDEADYYCQVWDSSSDHVVFGGGTK LTVLG |
| 63A10v1 | V$_L$22 | 224 | SYELTQPHSVSVATAQMARITCGGNNIGSKAVHW YQQKPGQDPVLVIYCDSNRPSGIPER FSGSNPGNTATLTISRIEAGDEADYYCQVWDSSSD GVFGGGTKLTVLG |
| 63A10v2 | V$_L$101 | 1846 | SYELTQPHSVSVATAQMARITCGGNNIGSKAVHW YQQKPGQDPVLVIYCDSNRPSGIPER FSGSNPGNTATLTISRIEAGDEADYYCQAWDSTTV VFGGGTKLTVLG |
| 63A10v3 | V$_L$102 | 1847 | SYELTQPPSVSVSPGQTANITCSGDKLGNRYTCWY QQKSGQSPVLVIYQDSERPSGIPER FSGSNSGNTATLTISGTQAMDEADYYCQAWDSTT VVFGGGTKLTVLG |
| 65H11v1 | V$_L$23 | 225 | SYELTQPHSVSVATAQMARITCGGNNIGSKTVHW FQQKPGQDPVLVIYSDSNRPSGIPERFSGSNPGNTA TLTISRIEAGDEADYYCQVWDSSCDGVFGGGTKLT VLG |
| 65H11v2 | V$_L$103 | 1848 | SYELTQPPSVSVSPGQTANITCSGDKLGDRYVCWY QQKPGQSPVLVIYQDSKRPSGIPEQFSGSNSGNTAT LTISGTQAIDEADYYCQAWDSITVVFGGGTKLTVLG |
| 67G10v1 | V$_L$9 | 226 | SYELTQPHSVSVATAQMARITCGGNNIGSKAVHW YQQKPGQDPVLVIYSDSNRPSGIPERFSGSNPGNTA TLTISRIEAGDEADYYCQVWDSSSDGVFGGGTKLT VLG |
| 67G10v2 | V$_L$10 | 227 | SYELTQPPSVSVSPGQTASITCSGDKLGDKYACWY QQKPGQSPVLVIYQDNERPSGIPERFSGSNSGNTAT LTISGTQAMDEADYYCQAWDSTTVVFGGGTKLTV LG |
| 64C8 | V$_L$24 | 228 | DVVMTQSPLSLPVTLGQPASISRRSSPSLVYSDGNT YLNCFQQRPGHSPRRLIYKGSNWDSGVPDRFSGSG SGTDFTLKISRVEAEDVGIYYCIQDTHWPTCSFGQ GTKLEIKR |
| 64A8 67B4 | V$_L$1 | 229 | DIQMTQSPSSLSASVGDRVTITCRASQDIRNDLGW YQQKPGKAPKRLIYAASNLQRGVPSRFSGSGSGTE FTLTISTLQPEDFATYSCLQHNSYPLTFGGGTKVEI KR |
| 63G8v1 | V$_L$104 | 1849 | DIQMTQSPSSLSASVGDRVTITCRASQDIRNDLGW YQQKPGKAPKRLIYAASNLQRGVPSRFSGSGSGTE FTLTISTLQPDDFATYSCLQHNSYPLTFGGGTKVEI KR |
| 63G8v2 | V$_L$105 | 1850 | DIQMTQSPSSLSASVGDRVTITCRASQGIRSGLGW YQQKPGKAPKRLIYAASNLQRGVPSRFSGSGSGTE FTLTVSSLQPEDFATYSCLQHNSYPLTFGGGTKVEI KR |
| 63G8v3 | V$_L$106 | 1851 | DIQMTQSPSSLSASVGDRVTITCRASQGIRSGLGW YQQKPGKAPKRLIYAASNLQRGVPSRFSGSGSGTE FTLTVSSLQPEDFATYSCLQHNTYPLTFGGGTKGEI RR |
| 66G2 | V$_L$12 | 230 | DIQMTQSPSSLSASVGDRVTITCRASQGIRNDLGW YQQKPGKAPKRLIYAASNLQSGVPSRFSGSGSGTK FTLTINSLQPEDFATYYCLQLNGYPLTFGGGTKVEI KR |
| 68D3v1 68D3v2 | V$_L$2 | 231 | DIQMTQSPSSLSASVGDRVTITCRASQDIRNDLGW YQQKPGKAPKRLIYAASNLQRGVPSRFSGSGSGTE FTLTISTLQPDDFATYSCLQHNSYPLTFGGGTKVEI KR |

TABLE 2A-continued

Exemplary Antibody Variable Light (V$_L$) Chains

| Contained in Clone | Designation | SEQ ID NO. | Amino Acid Sequence |
|---|---|---|---|
| 65D1 | V$_L$27 | 232 | SYDLTQPPSVSVSPGQTASITCSGDKLGDKYVCWY QQKPGQSPVLVIYQDSKRPSGIPERFSGSNSGNTAT LTISGIQAMDEADYYCQAWDSRVFGGGTKLTVLG |
| 64H5 65G4 | V$_L$8 | 233 | SYEMTQPLSVSVALGQTARITCGGNNIGSKNVHW YQQKPGQAPVLVIYRDSKRPSGIPERFSGSNSGNT ATLTISRAQAGDEADYYCQVWDSSVVFGGGTKL TVLG |
| 65D4 | V$_L$26 | 234 | SYELTQPLSVSVALGQTARIPCGGNDIGSKNVHWY QQKPGQAPVLVIYRDNRPSGIPERFSGSNSGNTA TLTISRAQAGDEADYYCQVWDSNPVVFGGGTKLT VLG |
| 65E3 | V$_L$25 | 235 | SYELTQPLSVSVALGQTARITCGGNNIGSKNVHWY QQKPGQAPVLVIYRDNRPSGIPERFSGSNSGNTA TLTISRAQAGDEADYYCQVWDSSTVVFGGGTKLT VLG |
| 68G5 | V$_L$13 | 236 | SYELTQPLSVSVALGQTARLTCGGNNIGSINVHWY QQKPGQAPVLVIYRDNRPSGIPERFSGSNSGNTA TLTISRAQAGDEADYYCQLWDSSTVVFGGGTKLT VLG |
| 67G8 | V$_L$28 | 237 | SYELTQPLSVSVALGQTARITCGGNNIGSYNVFWY QQKPGQAPVLVIYRDSKRPSGIPERFSGSNSGNTAT LTISRAQAGDEADYHCQVWDSSTVVFGGGTKLTV LG |
| 65B7v1 | V$_L$29 | 238 | EIVLTQSPGTLSLSPGERATLSCRASQSVSSIYLAW YQQKPGQAPRLLIYGASSRATGIPDRFSGSGSGTDF TLTISRLEPEDFAVYYCQQYGSSCSFGQGTKLEIKR |
| 65B7v2 | V$_L$107 | 1852 | DVVMTQSPLSLPVTLGQPASISYRSSQSLVYSDGD TYLNWFQQRPGQSPRRLIYKVSNWDSGVPDRFSG SGSGTDFTLKISRVEAEDVGVYYCMQGTHWRGW TFGQGTKVEIKR |
| 63B6 64D4 | V$_L$4 | 239 | EIVLTQSPGTLSLSPGERATLSCRASQSVSNSYLAW YQQKPGQAPRLLIYGAFSRATGIPDRFSGSGSGTDF TLTISRLEPEDFAVYYCQQFGRSFTFGGGTKVEIRR |
| 63F5 | V$_L$14 | 240 | EVVLTQSPGTLSLSPGERATLSCRASQTVRNNYLA WYQQQPGQAPRLLIFGASSRATGIPDRFSGSGSGT DFTLTISRLEPEDFAVYYCQQFGSSLTFGGGTKVEI KR |
| 65E8 63H11 64E6 65F11 67G7 | V$_L$3 | 241 | EIVLTQSPGTLSLSPGERATLSCRASQSVRNSYLAW YQQQPGQAPRLLIYGAFSRASGIPDRFSGSGSGTDF TLTISRLEPEDFAVYYCQQFGSSLTFGGGTKVEIKR |
| 65C1 | V$_L$16 | 242 | EIVLTQSPGTLSLSPGERATLSCRASQTIRNSYLAW YQQQPGQAPRLLIYGAFSRATGIPDRFSGGGSGTD FTLTISRLEPEDFAVYYCQQFGSSLTFGGGTKVEIKR |
| 66F6 | V$_L$15 | 243 | EIVLTQSPGTLSLSPGERATLSCRASQSVRNSYLAW YQQQPGQAPRLLIYGAFSRATGIPDRFSGSGSGTDF TLTISRLEPEDFAVYYCQQFGSSLTFGGGTKVEIKR |
| 64A6 | V$_L$30 | 244 | EILMTQSPATLSVSPGERATLSCRASQSVNSNLAW YQQKPGQAPRLLIYGTSTRATGVPARFGGSGSGTE FTLTISSLQSEDFAFYYCQQYNTWPWTFGQGTKVE IKR |
| 65F9 | V$_L$31 | 245 | EILMTQSPATLSVSPGERATLSCRASQSVSSNLAW YQQKPGQSPRLLIYGASTRATGIPARFGGSGSGTDF TLTISSLQSEDFAFYYCQQYNTWPWTFGQGTKVEI KR |
| 64A7 | V$_L$17 | 246 | EIVLTQSPGTLSLSPGERATLSCRASQSVSRNYLAW YQQKPGQAPRLLIYGASSRATGVPDRFSGSGSGTD FTLTISRLEPEDFAVYYCQQYGSSSLCSFGQGTNLD IRR |

TABLE 2A-continued

Exemplary Antibody Variable Light (V_L) Chains

| Contained in Clone | Designation | SEQ ID NO. | Amino Acid Sequence |
|---|---|---|---|
| 65C3<br>68D5 | $V_L5$ | 247 | EMVMTQSPATLSVSPGERATLSCRASQSVSSQLA<br>WYQEKPGRAPRLLIYGASNRAIDIPARLSGSGSGTE<br>FTLTISSLQSEDFAVYYCQQYNNWPWTFGQGTKV<br>EFKR |
| 67F5 | $V_L32$ | 248 | EIVMTQSPATLSVSPGERVTLSCRASQSVSSNLAW<br>YQQKPGQAPRLLIHGSSNRAIGIPARFSGSGSGTEF<br>TLTISSLQSADFAVYNCQQYEIWPWTFGQGTKVEI<br>KR |
| 64B10v1<br>64B10v2 | $V_L33$ | 249 | QSVLTQPPSVSAAPGQKVTISCSGSSSNIGNNYVA<br>WYQQLPGTAPKLLIYDNDKRPSGIPDRFSGSKSGT<br>SATLGITGLQTGDEADYYCGTWDSSLSAVVFGGG<br>TKLTVLG |
| 68C8 | $V_L34$ | 250 | QSVLTQPPSVSAAPGQKVTISCSGSSSNIGNNYVS<br>WYQQLPGTAPKLLIYDNNKRPSGIPDRFSGSKSGT<br>SATLGITGLQTGDEADYYCGTWDSSLSAVVFGGG<br>TKLTVLG |
| 67A5 | $V_L35$ | 251 | DIVMTQTPLSLPVTPGEPASISCRSSQSLLNSDDGN<br>TYLDWYLQKPGQSPQLLIYTLSYRASGVPDRFSGT<br>GSGTEFTLKISRVEAEDVGVYYCMQRLEFPITFGQ<br>GTRLEIKR |
| 67C10 | $V_L36$ | 252 | DFVMTQTPLSLPVTPGEPASISCRSSQSLLNSDDGN<br>TYLDWYLQKPGQSPQLLIYTLSYRASGVPDRFSGS<br>GSGTDFTLKISRVEAEDVGVYYCMQRIEFPITFGQ<br>GTRLEIKR |
| 64H6 | $V_L37$ | 253 | SYELTQPLSVSVALGQTARITCGGNNIGSKNVHWY<br>QQKPGQAPVVVIYRDSKRPSGIPERFSGSNSGNTA<br>TLTISRAQAGDEADYYCQVWDSSPVVFGGGTKLT<br>VLG |
| 63F9 | $V_L38$ | 254 | DIQMTQSPSSLSVSVGDRVTITCRASQDIRNDLAW<br>YQQTPGKAPKRLIYASSSLQSGVPSRFSGTGSGTEF<br>TLTISSLQPEDFATYFCLQRNSYPLTFGGGTKVEIKR |
| 67F6v1 | $V_L39$ | 255 | DIVMTQTPLSLPVIPGEPASIFCRSSQSLLNSDAGTT<br>YLDWYLQKPGQSPQLLIYTLSFRASGVPDRFSGSG<br>SGTDFTLKITRVEAEDVGVYYCMQRIEFPITFGQGT<br>RLEIKR |
| 67F6v2 | $V_L108$ | 1853 | DIVMTQTPLSLPVIPGEPASIFCRSSQSLLNSDAGTT<br>YLDWYLQKPGRSPQLLIYTLSFRASGVPDRFSGSG<br>SGTDFTLKITRVEAEDVGVYYCMQRIEFPITFGQGT<br>RLEIKR |
| 48C9<br>49A12<br>51E2 | $V_L78$ | 256 | DIQMTQSPSSLSASIGDRVTITCRASQNIRTYLNWY<br>QQKPGKAPKLLIYVASSLESGVPSRFSGTGSGTDF<br>ALTISSLQPEDFATYYCQQSDSIPRTFGQGTKVEIKR |
| 48F3 | $V_L77$ | 257 | DIQMTQSPSSLSASVGDRVTITCRASQRISSYLNWY<br>QQKPGKAPKFLIYAVSSLQSGVPSRFSGSGSGTDFT<br>LTISSLEPEDFATYYCQQSYSATFTFGPGTKVDIKR |
| 48F8<br>53B9<br>56B4<br>57E7<br>57F11 | $V_L49$ | 258 | EIVLTQSPDFQSVTPKEKVTITCRASQDIGNSLHWY<br>QQKPDQSPKLLIKFASQSFSGVPSRFSGSGSGTDFA<br>LTINSLEAEDAATYYCHQSSDLPLTFGGGTKVDIKR |
| 48H11 | $V_L40$ | 259 | DIQMTQSPSSLSTSVGDRVTITCRASQNIRSYLNWY<br>QLKPGKAPKVLIYGASNLQSGVPSRFSGSGSGTDF<br>TLTISNLQSEDFAIYYCQQSYNTPCSFGQGTKLEIKR |
| 49A10<br>48D4 | $V_L65$ | 260 | DIVMTQTPLSLPVTPGEPASISCRSSQSLLDSDDGN<br>TYLDWYLQKPGQSPQLLIYTLSYRASGVPDRFSGS<br>GSGTDFTLKISRVEAEDVGVYYCMQRIEFPITFGQ<br>GTRLEIKR |

TABLE 2A-continued

Exemplary Antibody Variable Light (V_L) Chains

| Contained in Clone | Designation | SEQ ID NO. | Amino Acid Sequence |
|---|---|---|---|
| 49C8 52H1 | $V_L 45$ | 261 | DIQMTQSPSSLSASVGDRVTFTCQASQDINIYLNW YQQKPGKAPKLLIYDVSNLETGVPSRFSGSGSGTD FTFTISSLQPEDIATYFCQQYDNLPFTFGPGTKVDL KR |
| 49G2 50C12 55G11 | $V_L 66$ | 262 | DIVLTQTPLSLPVTPGEPASISCRSSQSLLDSDDGDT YLDWYLQKPGQSPQLLIYTLSYRASGVPDRFSGSG SGTDFTLKISRVEAEDVGVYYCMQHIEFPSTFGQG TRLEIKR |
| 49G3 | $V_L 47$ | 263 | DIQMTQSPSSLSASIGDRVTITCQASQGISNYLNWY QQKPGKAPKLLIYDASNLETGVPSRFSGSGSGTDF TFTISSLQPEDIATYYCHQYDDLPLTFGGGTKVEIRR |
| 49H12 | $V_L 43$ | 264 | DIQMTQSPSSLSASVGDRVTITCQASQDITKYLNW YQQKPGKAPKLLIYDTFILETGVPSRFSGSGSGTDF TFTISSLQPEDIATYYCQQYDNLPLTFGQGTRLEIKR |
| 51A8 | $V_L 61$ | 265 | NFILTQPHSVSESPGKTVTISCTRSSGSIASDYVQW YQQRPGSSPTTVIYEDKERSSGVPDRFSGSIDSSSNS ASLTISGLKTEDEADYYCQSYDRNNHVVFGGGTK LTVLG |
| 51C10.1 | $V_L 55$ | 266 | SYELTQPPSVSVSPGQTARITCSGDALPKKYAYWY QQKSGQAPVLVIYEDSKRPSGIPERFSGSISGTMAT LTISGAQVEDEADYYCYSTDSSVNHVVFGGGTKL TVLG |
| 51C10.2 | $V_L 70$ | 267 | SYDLTQPPSVSVSPGQTASITCSGDELGDKYACWY QQKPGQSPVLVIYQDTKRPSGIPERFSGSNSGNTAT LTISGTQAMDEADYYCQAWDSGTVVFGGGTKLT VLG |
| 51E5 | $V_L 79$ | 268 | DIQMTQSPSSLSASVGDRVTITCRASQDIRNDLGW YQQKPGKAPNRLIYAASSLQFGVPSRFSGSGSGTE FTLTISSLQPEDFATYYCLQHSSYPLTFGGGTRVEI KR |
| 51G2 | $V_L 51$ | 269 | DIQMTQSPSSVSASVGDRVTITCRASQGISSWLAW YQQKPGKAPKLLIYDASSLQSGVPSRFSGSGSGTD FTLTISSLQPEDFATYYCQQTNSFPPWTFGQGTKVE IKR |
| 52A8 | $V_L 41$ | 270 | DIQMTQSPSFLSASVGDRVTITCRASQTISSYLNWH QQKPGKAPKLLIYAASSLQSGVPSRFSGSGSGTDFS LTISSLQPEDFATYYCQQSYSTPLTFGGGTKVEIKR |
| 52B8 | $V_L 82$ | 271 | EVVLTQSPATLSVSPGGRATLSCRASQSVSDILAW YQQKPGQAPRLLIYGASTRATGIPARFSGGGSGTE FTLTISSLQSEDFAVYFCQQYNNWPLTFGGGTKVE IKR |
| 52C1 | $V_L 67$ | 272 | QSVLTQPPSVSAAPGQKVTISCSGSSSNIGINYVSW YQQLPGTAPKLLIYDNNKRPSGIPDRFSGSKSGTSA TLGITGLQTGDEADYCCGTWDSSLSAVVFGGGTK LTVLG |
| 52F8 | $V_L 42$ | 273 | DIVMTQSPLSLPVTPGEPASISCRSSQSLLHSNGYN YLDWYLQKPGQSPQLLIYLGSNRASGVPDRFSGR GSGTDFSLKISRVEAEDVGIYYCMQALQTPFTFGP GTNVDIKQ |
| 52H2 | $V_L 84$ | 274 | ENVLTQSPGTLSLSPGERATLSCRASQSVRSSYLA WYQQRPGQAPRLLIFGASRRATGIPDRFSGSGSGT DFTLTISRLEPEDFAVYYCQQYGSSPRSFGQGTKLE IKR |
| 53F6 | $V_L 63$ | 275 | DIVMTQSPLSLPVTPGEPASISCRSSQSLQHSNGYN YLDWYLQKPGQSPQLLIYDSNRASGVPDRFSGSG SGTDFTLKISRVEAEDIGVYYCMQGLQTPPTFGGG TKVEIKR |

TABLE 2A-continued

Exemplary Antibody Variable Light ($V_L$) Chains

| Contained in Clone | Designation | SEQ ID NO. | Amino Acid Sequence |
|---|---|---|---|
| 53H5.2 | $V_L$62 | 276 | DIQMTQSPSSLSASVGDRVTITCRASQGIRNDLGW YQQKPGKAPKRLIYAASSLQSGVPSRFSGSGSGTE FTLTISSLQPEDFATYYCLQHKSYPFTFGPGTKMDI KG |
| 53H5.3 | $V_L$80 | 277 | EIVMTQSPVTLSVSPGERAIISCRASQSVSSNVAWY QQKPGQTPRLLIYGASTRATGLPTRFSGSGSGTVFT LTISSLQPEDFAVYYCQQFSNSITFGQGTRLEIKR |
| 54A1 55G9 | $V_L$44 | 278 | DIQMAQSPSSLSASVGDRVTITCQASQDISIYLNWY QLKPGKAPKLLIYDVSNLETGVPSRFSGGGSGTDF TFTISSLQPEDIATYYCQQYDNLPLTFGPGTKVDIKR |
| 54H10.1 55D1 48H3 53C11 | $V_L$53 | 279 | EIVVTQSPGTLSLSVGERAILSCRASQSFSSSYLAW YQQKPGQAPRLLIYGASSRATGIPDRFSGSGSGTDF TLTISRLEPEDFAVYYCQQYGSSRTFGQGTKVEIKR |
| 55D3 | $V_L$71 | 280 | DIQMTQSPSSLSVSVGDRVTITCRASQDISNYLAWF QQKPGKAPKSLIYAASSLQSGVPSKFSGSGSGTDFT LTISSLQPEDFATYYCQQYNIYPRTFGQGTKVEIKR |
| 55E4 49B11 50H10 53C1 | $V_L$75 | 281 | DIQMTQSPSSLSTSIGDRITITCRASQSISNYLNWFQ QIPGKAPRLLIYTASSLQSGVPSRFSGSGSGTDFTLT ISSLQPEDFATYYCQQSSSIPWTFGQGTKVEIKR |
| 55E9 | $V_L$68 | 282 | DIVMTQSPLSLPVTPGEPASISCRSSQSLLHSNGFN YLDWYLQKPGQSPQVLIYLGSNRASGVPDRFSGS GSGTDFTLKISRVEAEDVGIYYCMQALQTLITFGQ GTRLEIKR |
| 55G5 | $V_L$83 | 283 | SYELTQPPSVSVSPGQTASITCSGDNLGDKYAFWY QQKPGQSPVLIYQDNKRPSGIPERFSGSNSGNTAT LTISGTQAVDEADYYCQAWDSATVIFGGGTKLTV LG |
| 56A7 56E4 | $V_L$52 | 284 | DIQMTQSPSSVSASVGDRVTITCRASQDISSWLAW YQQKPGKAPKFLIYDASTLQSGVPSRFSGSGSGAD FTLTINNLQPEDFATYYCQQTNSFPPWTFGQGTKV EIKR |
| 56C11 | $V_L$64 | 285 | SYVLTQPPSVSVAPGQAARITCGGNDIGSKSVHWY QQKPGQAPVLVVYDDSDRPSGIPERFSGSKSGNTA TLIISRVEAGEEADYYCQVWDSSSDVVFGGGTKLT VLG |
| 56E7 | $V_L$86 | 286 | DLQMTQSPSSLSASVGDRVTITCQASQDIKKFLNW YQQKPGKAPNLLIYDASNLETGVPSRFSGSGSGTD FTFTISSLQPEDIATYYCQQYAILPFTFGPGTTVDIKR |
| 56G1 | $V_L$76 | 287 | DIQMTQSPSSLSASVGDRVTITCRASQSISNYLNWF LQIPGKAPKLLIYAASSLQSGVPSRFSGSGSGTDFT LTINSLQPEDFGTYYCQQSSTIPWTFGQGTKVEIKR |
| 56G3.3 55B10 | $V_L$81 | 288 | EIVLTQSPGTLSLSPGERATLSCRASQSVSRDYLAW YRQKPGQAPRLLVYGASARATGIPDRFSGSGSGTD FTLTISRLEPEDFAVYYCQQYGRSLFTFGPGTKVDI KR |
| 57B12 | $V_L$72 | 289 | DIQMTQSPSSLSVSVGDRVTITCRASHDISNYLAWF QQKPGKAPKSLIYAASSLQSGVPSKFSGSGSGTDFT LTISSLQPEDFATYYCQQYNTYPRTFGQGTKVEIKR |
| 57D9 | $V_L$87 | 290 | EIVLTQSPGTLSLSPGERATLSCRASPSVSSSYLAW YQQKPAQAPRLLIYGASSRATGIPDRFSGSGSGTDF TLTISRLEPEDFAVYYCHQYGTSPCSFGQGTKLEIKR |
| 59A10 49H4 | $V_L$48 | 291 | DIQMTQSPSSVSASVGDRVTITCRASQGISSWLAW YQQKPGKAPKLLIYGASSLQSGVPSRFSGSGSGTD FTLTISSLQPEDFATYYCQQTNSFPPWTFGQGTKVE IKR |

TABLE 2A-continued

Exemplary Antibody Variable Light (V$_L$) Chains

| Contained in Clone | Designation | SEQ ID NO. | Amino Acid Sequence |
|---|---|---|---|
| 59C9 58A5 57A4 57F9 | V$_L$50 | 292 | DIQMTQSPSSVSASVGDRVTITCRASQDIDSWLVW YQQKPGKAPNLLIYAASNLQRGVPSRFSGSGSGTD FTLTIASLQPEDFATYYCQQTNSFPPWTFGQGTKV EIKR |
| 59G10.2 | V$_L$60 | 293 | SYELSQPPSVSVSPGQTVSITCSGDNLGDKYACWY QQRPGQSPVLVIYQDTKRPSGIPERFSGSNSGNTAT LTISGTQAMDEADYYCQAWDSSTTWVFGGGTKL TVLG |
| 59G10.3 | V$_L$54 | 294 | QSVLTQPPSVSAAPGQKVTISCSGSSSNIGDNYVS WYQQFPGTAPKLLIYDNNKRPSGIPDRFSGSKSGT SATLGITGLQTGDEADYYCGTWDSSLSVMVFGGG TKLTVLG |
| 60D7 | V$_L$69 | 295 | DIVLTQTPLSLPVTPGEPASISCRSSQSLLDSDDGDT YLDWYLQKPGQSPQLLIYTLSYRASGVPDRFSGSG SGTDFTLKISRVEAEDVGVYYCMQRIEFPLTFGGG TKVEIKR |
| 60F9 48B4 52D6 | V$_L$58 | 296 | EIMLTQSPGTLSLSPGERATLSCRASQRVPSSYIVW YQQKPGQAPRLLIYGSSNRATGIPDRFSGSGSGTDF TLTIGRLEPEDFAVYYCQQYGSSPPWTFGQGTKVA IKR |
| 60G5.2 | V$_L$46 | 297 | SYELTQPPSVSVSPGQTASITCSGNKLGDKYVCWY QQKPGQSPVLVIYQDSKRPSGIPERFSGSNSGNTAT LTISGTQALDEADYYCQAWDSSTWVFGGGTKLTV LG |
| 61G5 | V$_L$59 | 298 | EIMLTQSPGTLSLSPGERATLSCRASQRVPSSYLVW YQQKPGQAPRLLIYGASNRATGIPDRFSGSGSGTD FTLTIGRLEPEDFAVYYCQQYGSSPPWTFGQGTKV AIKR |
| 52C5 | V$_L$73 | 299 | DIQMTQSPSSLSASIGDRVTITCRASQSISNYLNWF QQIPGKAPRLLIYAASSLQSGVPSRFSGSGSGTDFT LTISSLQPEDFAIYYCQQSSSIPWTFGQGTKVEIKR |
| 61H5 52B9 | V$_L$88 | 300 | EIVLTQSPGTLSLSPGERATLSCRASQSVSRDYLAW YRQKPGQAPRLLIYGASSRATGIPDRFSGSGSGTDF TLTISRLEPEDFAVYYCQQYGRSLFTFGPGTTVDIKR |
| 59D10v1 | V$_L$56 | 301 | SYELTQPPSVSVSPGQTARITCSGDAVPKKYANWY QQKSGQAPVLVIYEDSKRPSGIPERFSGSSSGTMAT LTISGAQVEDEADYYCYSTDSSGNHVVFGGGTKL TVLG |
| 59D10v2 | V$_L$57 | 302 | SYELTQPPSVSVSPGQTASITCSGDKLGDKYVCWY QQMPGQSPVLVIHQNNKRPSGIPERFSGSNSGNTA TLTISGTQAMDEADYYCQAWDSSTAVFGGGTKLT VLG |
| 56G3.2 | V$_L$85 | 303 | ETVMTQSPATLSVSPGERATLSCRARQSVGSNLIW YQQKPGQAPRLLIFGASSRDTGIPARFSGSGSGTEF TLTISSLQSEDFAVYYCQQYNNWPLTFGGGTKVEI KR |
| 48G4 53C3.1 | V$_L$89 | 304 | EIVLTQSPGTLSLSPGERATLSCRASQSVASSYLVW YQQKPGQAPRLLIYGAFSRATGIPDRFSGSGSGTDF TLTIRRLEPEDFAVYYCQQYGTSPFTFGPGTKVDL KR |
| 50G1 | V$_L$90 | 305 | DIVMTQTPLSLPVSPGEPASISCRSSQSLLDSDDGD TYLDWYLQKPGQSPQLLIYTLSYRASGVPDRFSVS GSGTDFTLKISRVEAEDVGVYYCMQRIEFPLTFGG GTKVEIKR |
| 58C2 | V$_L$91 | 306 | EIVMTQTPLSLPVTPGEPASISCRSSQSLFDNDDGD TYLDWYLQKPGQSPQLLIYTLSYRASGVPDRFSGS GSGTDFTLKISRVEAEDVGVYYCMQRLEFPITFGQ GTRLEIKR |

TABLE 2A-continued

Exemplary Antibody Variable Light (V_L) Chains

| Contained in Clone | Designation | SEQ ID NO. | Amino Acid Sequence |
|---|---|---|---|
| 60G5.1 | V_L74 | 1854 | DIQMTQSPSSLSASIGDRVTITCRASQSISNYLNWF QQIPGKAPRLLIYAASSLQSGVPSRFSGSGSGTDFT LTISSLQPEDFATYYCQQSSSIPWTFGQGTKVEIKR |
| 50D4 | V_L92 | 307 | DIQMTQSPSSLSASVGDRVTITCRASQDISNYLAW YQQKPGKVPTLLIYAASTLLSGVPSRFSGSGSGTDF TLTISSLQPEDVAAYYCQKYYSAPFTFGPGTKVDI NR |
| 50G5 v1 | V_L93 | 308 | DIQMTQSPSSLSASVGDRVTITCRASQGIRNDLGW YQQKPGKAPNRLIYAASSLQSGVPSRFSGSGSGTE FTLTISSLQPEDFATYYCLQHNSYPRTFGQGTKVEI KR |
| 50G5 v2 | V_L94 | 309 | DVVMTQCPLSLPVTLGQPASISCRSSQRLVYSDGN TYLNWVQQRPGQSPRRLIYKVSNWDSGVPDRFSG SGSGTDFTLKISRVEAEDVGVNYCMEGTHWPRDF GQGTRLEIKR |
| 51C1 | V_L95 | 310 | DIQMTQSPSSLSASIGDRVTITCRASQSISNYLNWF QQIPGKAPRLLIYAASSLQSGVPSRFSGSGSGTDFT LTISSLQPEDFATYYCQQSSSIPWTFGQGTTVEIKR |
| 53C3.2 | V_L96 | 311 | DIVMTQSPATLSVSPGERATLSCRASQSISSNLAWY QQTPGQAPRLLIYGTSIRASTIPARFSGSGSGTEFTL TISSLQSEDFAIYYCHQYTNWPRTFGQGTKVEIKR |
| 54H10.3 | V_L97 | 312 | DIQMTQSPSSLSASVGDRVTITCRASQTISIYLNWY QQKPGKAPKFLIYSASSLQSGVPSRFSGSGSGTDFT LTISSLQPEDFSTYFCQQSYSSPLTFGGGTKVEIKR |
| 55A7 | V_L98 | 313 | DIQMTQSPSSLSASVGDRVTITCRASQSISSYLNWY QQKPGKAPKLLIYAASSLQSGVPSRFSGSGSGTDFT LTISSLQPEDFATYYCQQTYSAPFTFGPGTKVDIKR |
| 55E6 | V_L99 | 314 | EIVLTQSPGTLSLSPGERATLSCRASQSVSRSHLAW YQQNSGQAPRLLIYGASSRATGIPDRFSGSGSGTDF TLTISRLEPEDFAVYYCQQYGSSPWTFGQGTKVEI KR |
| 61E1 | V_L100 | 315 | DIQMTQSPSSLSASIRDRVTITCRASQSIGTFLNWY QQKPGTAPKLLIYAASSLQSGVPSRFSGSGSGTDFT LTISSLHPEDFASYYCQQSFSTPLTFGGGTKVEITR |

TABLE 2B

Exemplary Antibody Variable Heavy (V_H) Chains

| Contained in Clone | Designation | SEQ ID NO. | Amino Acid Sequence |
|---|---|---|---|
| 63E6 66F7 | V_H 6 | 316 | QVQLMQSGAEVKKPGASVKVSCKASGYTFTGY YMHWVRQAPGQGLEWMGWMNPNSGATKYA QKFQGRVTMTRDTSISTAYMELSRLRSDDTAVY YCARELGDYPFFDYWGQGTLGIVSS |
| 66D4 | V_H17 | 317 | QVQLVQSGAEVKKPGASVKVSCRASGYTFTGY YIHWMRQAPGHGLEWMGWINPPSGATNYAQK FRGRVAVTRDTSISTVYMELSRLRSDDTAVYYC ARETGTWNFFDYWGQGTLVTVSS |
| 66B4 | V_H10 | 318 | QVQLVQSGAEVKKPGASVKVSCKASGYTFTGY YLHWVRQAPGQGLEWMGWINPNSGGTDYAQK FQGRVTMTRDTSISTAYMELSRLRSDDTAVYYC VGDAATGRYYFDNWGQGTLVTVSS |
| 65B1 | V_H18 | 319 | QVQLVQSGAEVKRPGASVKVSCKASGYTFTGY FMHWVRQAPGQGLEWMGWINPNSGATNYAQ KFHGRVTMTRDTSITTVYMELSRLRSDDTAVY YCTRELGIFNWFDPWGQGTLVTVSS |

TABLE 2B-continued

Exemplary Antibody Variable Heavy (V$_H$) Chains

| Contained in Clone | Designation | SEQ ID NO. | Amino Acid Sequence |
|---|---|---|---|
| 65B4 | V$_H$20 | 320 | EVQLVESGGGLVQPGGSLRLSCAASGFAFSSYD MHWVRQATGKGLEWVSTIDTAGDAYYPGSVK GRFTISRENAKTSLYLQMNSLRAGDTAVYYCTR DRSSGRFGDFYGMDVWGQGTAVTVSS |
| 67A4 | V$_H$19 | 321 | EVQLEESGGGLVQPGGSLRLSCAASGFTFRTYD MHWVRQVTGKGLEWVSAIGIAGDTYYSDSVK GRFTISRENAKNSLYLQMNSLRVGDTAVYYCA RDRSSGRFGDYYGMDVWGQGTTVTVSS |
| 63A10v1 63A10v2 63A10v3 | V$_H$21 | 322 | EVQLVESGGDLVKPGGSLRLSCAVSGITFSNAW MSWVRQAPGKGLEWVGRIKSKTDGGTTDYAA PVKGRFTVSRDGSKNTLYLQMNSLKTEDTAVY YCTTDSSGSYYVEDYFDYWGQGTLVTVSS |
| 65H11v1 65H11v2 | V$_H$22 | 323 | EVQLVESGGGLVKPGGSLRLSCAASGFTFSNAW MSWVRQAPGKGLEWVGRIIGKTDGGTTDYAAP VKGRFTISRDDSKNTLYLQMNSLKTEDTAVYY CTSDSSGSYYVEDYFDYWGQGTLVAVSS |
| 67G10v1 67G10v2 | V$_H$9 | 324 | EVQLVESGGGLVKPGGSLRLACAASGITFNNA WMSWVRQAPGKGLEWVGRIKSKTDGGTTDYA APVKGRFTISRDDSKSILYLQMNSLKSEDTAVY YCTTDSSGSYYVEDYFDYWGQGTLVTVSS |
| 64C8 | V$_H$23 | 325 | QVQLVESGGGVVQPGRSLRLSCVASGFTFSSYG MHWVRQDPGKGLEWVAVISYDGSNKHYADSV KGRFTISRDNSKNTLYLQMNSLRAEDTAVYYC ARELLWFGEYGVDHGMDVWGQGTTVTVSS |
| 63G8v1 63G8v2 63G8v3 68D3v1 64A8 67B4 | V$_H$1 | 326 | QAQLVESGGGVVQPGRSLRLSCAASGFTFSSYG IHWVRQAPGKGLEWVAVISYDGSNKYYADSVK GRFTISRDNSKNTLYLQMNSLRAEDTAVYYCAT TVTKEDYYYYGMDVWGQGTTVTVSS |
| 68D3v2 | V$_H$95 | 1855 | QAQLVESGGGVVQPGRSLRLSCAASGFTFSSYG MHWVRQAPGKGLEWVAFISYAGSNKYY ADSVKGRFTISRDNSKNTLYLQMSSLRAEDTAV YYCATTVTEEDYYYYGMDVWGQGTTVT VSS |
| 66G2 | V$_H$11 | 327 | QVQLVESGGGVVQPGRSLRLSCAASGFTFSSYG MHWVRQAPGKGLEWVAGISYDGSNKNYADSV KGRITISRDNPKNTLYLQMNSLRAEDTAVYYCA TTVTKEDYYYYGMDVWGQGTTVTVSS |
| 65D1 | V$_H$26 | 328 | QVQLVESGGGVVQPGRSLRLSCAASGFTFSYYY IHWVRQAPGKGLEWVALIWYDGSNKDYADSV KGRFTISRDNSKNTLYLHVNSLRAEDTAVYYCA REGTTRRGFDYWGQGTLVTVSS |
| 64H5 | V$_H$7 | 329 | QVQLVESGGGVVQPGRSLRLSCAASGFTFSSYG MHWVRQAPGKGLEWVAVIWDDGSNKYYADS VKGRFTISRDNSKNTLSLQMNSLRAEDTAVYYC AREYVAEAGFDYWGQGTLVTVSS |
| 65D4 | V$_H$25 | 330 | QEQLVESGGGVVQPGRSLRLSCAVSGFTFSFYG MHWVRQAPGKGLEWVAVIWYDGSNKYYADS VKGRFTISRDNSKNTLYLQMNSLRAEDTAVYY CTRALNWNFFDYWGQGTLVTVSS |
| 65E3 | V$_H$24 | 331 | QVQLVESGGGVVQPGRSLRLSCAASGFTLSNYN MHWVRQAPGKGLEWVAVLWYDGNTKYYADS VKGRVTISRDNSKNTLYLQMNSLRAEDTAVYY CARDVYGDYFAYWGQGTLVTVSS |
| 65G4 | V$_H$8 | 332 | QVQLVESGGGVVQPGRSLRLSCAASGFTFSSYG MHWVRQAPGKGLEWVAVIWDDGSNKYY ADSVKGRFTISRDNSKNTLSLQMNSLRAEDTAV YYCAREYVAEAGFDYWGQGTLVTVSS |

TABLE 2B-continued

Exemplary Antibody Variable Heavy (V$_H$) Chains

| Contained in Clone | Designation | SEQ ID NO. | Amino Acid Sequence |
|---|---|---|---|
| 68G5 | V$_H$12 | 333 | QVQLVESGGGVVQPGRSLRLSCTASGFTFSSYG MHWVRQAPGKGLEWVAVIWYDGSNKYHADS VKGRFTISRDDSKNALYLQMNSLRAEDTAVYY CVRDPGYSYGHFDYWGQGTLVTVSS |
| 67G8 | V$_H$27 | 334 | QVQLVESGGGVVQPGRSLRLSCAASGFTFSSYG MHWVRQAPGKGLEWVAVIWYDGSNKDYADS VKGRFTISRDNSKNTLYLQMNSLRAEDTAVYY CARSAVALYNWFDPWGQGTLVTVSS |
| 65B7v1 65B7v2 | V$_H$28 | 335 | QVQLQESGPGLVNPSQTLSLTCTVSGGSISSDAY YWSWIRQHPGKGLEWIGYIFYSGSTYYNPSLKS RVTISVDTSKNRFSLKLSSVTAADTAVYYCARE SRILYFNGYFQHWGQGTLVTVSS |
| 63B6 64D4 | V$_H$4 | 336 | QVQLQESGPGLVKPSQTLSLTCAVSGGSISSGDY YWSWIRQHPGKGLEWIGYIYYSGTTYYNPSLKS RVTISVDTSKNQFSLKLTSVTAADTAVYYCARM TTPYWYFGLWGRGTLVTVSS |
| 63F5 | V$_H$13 | 337 | QVQLQESGPGLVKPSQTLSLTCPVSGGSISSGDY YWTWIRQHPGKDLEWITYIYYSGSAYYNPSLKS RVTISVDTSKNQFSLKLSSVTAADTAVYYCARM TTPYWYFDLWGRGTLVTVSS |
| 63H11 | V$_H$3 | 338 | QVQLQESGPGLVKPSQTLSLTCPVSGGSISSGDY YWTWIRQHPGKGLEWIAYIYYSGSTYYNPSLKS RVTISVDTSKNQFSLKLSSVTAADTAVYYCARM TTPYWYFDLWGRGTLVTVSS |
| 65E8 64E6 65F11 67G7 | V$_H$2 | 339 | QVQLQESGPGLVKPSQTLSLTCPVSGGSISSGDY YWTWIRQHPGKGLEWIAYIYYTGSTYYNPSLKS RVTISVDTSKNQFSLKLSSVTAADTAVYYCARM TTPYWYFDLWGRGTLVTVSS |
| 65C1 | V$_H$15 | 340 | QVQLQESGPGLVKPSQTLSLTCPVSGGSISSGDY YWTWIRQHPGKGLEWIAYIFYSGSTYYNPSLKS RVTISLDTSKNQFSLKLNSVTAADTAVYYCARM TSPYWYFDLWGRGTLVTVSS |
| 66F6 | V$_H$14 | 341 | QVQLQESGPGLVKPSQTLSLTCPVSGGSISSGDY YWTWIRHHPGKGLEWIAYIYYSGSTYYNPSLKS RVTISVDTSKNQFSLKLNSVTAADTAVYYCAR MTTPYWYFDLWGRGTLVTVSS |
| 64A6 | V$_H$29 | 342 | QVQLQESGPGLVKPSQTLSLTCTVSGGSISSGGY YWSWIRQRPGKGLEWVGYIYYSGGTHYNPSLK SRVTISIDTSENQFSLKLSSVTAADTAVYYCARV LHYSDSRGYSYYSDFWGQGTLVTVSS |
| 65F9 | V$_H$30 | 343 | QVQLQESGPGLVKPSQTLSLTCTLSGGSFSSGDY YWSWIRQHPGKGLEWIGYIYYSGSTYYNPSLKS RVTISIDTSKNQFSLKLTSVTAADTAVYYCARV LHYYDSSGYSYYFDYWGQGTLVTVSS |
| 64A7 | V$_H$16 | 344 | QLQLQESGPGLVKPSETLSLTCTVSGGSISSDTS YWGWIRQPPGKGLEWIGNIYYSGTTYFNPSLKS RVSVSVDTSKNQFSLKLSSVTAADTAVFYCARL RGVYWYFDLWGRGTLVTVSS |
| 65C3 68D5 | V$_H$5 | 345 | QVQLQESGPGLVKPSETLSLTCTVSGGSISSYYW SWIRQPPGKGLEWIGYIYYTGSTNYNPSLKSRV TISVDTSKNQFSLKLSSVTAADTAVYYCAREYY YGSGSYYPWGQGTLVTVSS |
| 67F5 | V$_H$31 | 346 | QVQLKESGPGLVKPSETLSLTCTVSGGSISSYYW SWIRQPPGKGLEWIGYIYYSGNTNYNPSLKSRV TISVDTSKNQFSLKLSSVTAADTAVYYCAREYY YGSGSYYPWGQGTLVTVSS |
| 64B10v1 | V$_H$32 | 347 | QIQLLESGPGLVKPSETLSLTCTVSGGSVSSGDY YWSWIRQPPGKGLEWIGFIYYSGGTNYNPSLKS RVTISIDTSKNQFSLKLNSVTAADTAVYYCARY SSTWDYYYGVDVWGQGTTVTVSS |

TABLE 2B-continued

Exemplary Antibody Variable Heavy (V$_H$) Chains

| Contained in Clone | Designation | SEQ ID NO. | Amino Acid Sequence |
|---|---|---|---|
| 64B10v2 | V$_H$96 | 1856 | QVQLLESGPGLVKPSETLSLTCTVSGGSVSSGD YYWSWIRQPPGKGLEWIGFIYYSGGTNYNPPLK SRVTISIDTSKNQFSLKLSSVTAADTAVYYCARY SSTWDYYYGVDVWGQGTTVTSS |
| 68C8 | V$_H$33 | 348 | QVQLQESGPGLVKPSETLSLTCTVSGDSVSSGD NYWSWIRQPPGKGLEWIGFMFYSGSTNYNPSL KSRVTISLHTSKNQFSLRLSSVTAADTAVYYCG RYRSDWDYYYGMDVWGQGTTVTSS |
| 67A5 | V$_H$34 | 349 | EVQLVQSGAEVKKPGESLKISCKGSGYSFTSYW IGWVRQMPGKGLEWMGIIYPGDSDTRYSPSFQG QVTISADKSINTAYLQWSSLKASDTAIYFCARR ASRGYRFGLAFAIWGQGTMVTVSS |
| 67C10 | V$_H$35 | 350 | EVQLVQSGAEVKKPGESLKISCQGSGYSFSSYW IGWVRQMPGKGLEWMGIIYPGDSDTRYSPSFQG QVTISADKSINTAYLQWSSLKASDTAIYYCARR ASRGYRYGLAFAIWGQGTMVTVSS |
| 64H6 | V$_H$36 | 351 | EVQLVQSGAEVKKPGESLKISCKGSGYSFTSYW IGWVRQMPGKGLEWMGIIYPGDSETRYSPSFQG QVTISADKSISTAYLQWNSLKTSDTAMYFCATV AVSAFNWFDPWGQGTLVTVSS |
| 63F9 | V$_H$37 | 352 | QVQLKESGPGLVKPSQTLSLTCTVSGGSISSGGY YWNWIRQHPGKGLEWIGYIYDSGSTYYNPSLKS RVTMSVDTSKNQFSLKLSSVTAADTAVYYCAR DVLMVYTKGGYYYYGVDVWGQGTTVTVSS |
| 67F6v1 67F6v2 | V$_H$38 | 353 | EVQLVQSGAEVKKPGESLKISCKGSGYSFTGYW IGWVRQLPGKGLEWMGIIYPGDSDTRYSPSFQG QVTISVDKSINTAYLQWSSLKASDTAMYYCAR RASRGYSYGHAFDFWGQGTMVTVSS |
| 48C9 49A12 51E2 | V$_H$73 | 354 | QVQLQQWGAGLLKPSETLSLTCSVYGGSFSGY YWTWIRQPPGKGLEWIGEINHSENTNYNPSLKS RVTISIDTSKNQFSLKLSSVTAADTAVYYCARES GNFPFDYWGQGTLVTVSS |
| 48F3 | V$_H$72 | 355 | QVQLQQWGAGPLKPSETLSLTCAVYGGSISGYY WSWIRQPPGKGLEWIGEITHTGSSNYNPSLKSR VTISVDTSKNQFSLKLSSVTAADTAVYYCARGG ILWFGEQAFDIWGQGTMVTVSS |
| 48F8 53B9 56B4 57E7 57F11 | V$_H$48 | 356 | EVQLVESGGGLVKPGGSLRLSCTASGFTFRSYS MNWVRQAPGKGLEWVSSISSSSSYEYYVDSVK GRFTISRDIAKSSLWLQMNSLRAEDTAVYYCAR SLSIAVAASDYWGKGTLVTVSS |
| 48H11 | V$_H$39 | 357 | QVQLVQSGAEVKKPGASVKVSCKASGYTFTGY YKHWVRQAPGQGLEWMGWINPNSGATKYAQ KFQGRVTMTRDTSISTVYMELSRLRSVDTALYY CAREVPDGIVVAGSNAFDFWGQGTMVTVSS |
| 49A10 48D4 | V$_H$62 | 358 | QVHLVESGGGVVQPGRSLRLSCAASGFTFSNYG MHWVRQAPGKGLEWVAIIWYDGSNKNYADSV KGRFTISRDNSKNTLYLEMNSLRAEDTAVYYCA RDQDYDFWSGYPYFYYYGMDVWGQGTTVTVSS |
| 49C8 52H1 | V$_H$44 | 359 | QVQLVQSGAEVKKPGASVKVSCKASGYTFTSY DIDWVRQATGQGLEWMGWMNPNGGNTGYAQ KFQGRVTMTRNTSINTAYMELSSLRSEDTAIYY CARGKEFSRAEFDYWGQGTLVTVSS |
| 49G2 50C12 55G11 | V$_H$63 | 360 | QVQLVESGGGVVQPGRSLRLSCAASGFTFSNYG MRWVRQAPGKGLEWVALIWYDGSNKFYADSV KGRFTISRDNSKNTLNLQMNSLRAEDTAVYYC ARDRYYDFWSGYPYFFYYGLDVWGQGTTVTV SS |

TABLE 2B-continued

Exemplary Antibody Variable Heavy (V$_H$) Chains

| Contained in Clone | Designation | SEQ ID NO. | Amino Acid Sequence |
|---|---|---|---|
| 49G3 | V$_H$46 | 361 | QVTLKESGPVLVKPTETLTLTCTVSGFSLSNPRM GVSWIRQPPGKALEWLTHIFSNDEKSYSTSLKSR LTISKDTSKSQVVLSMTNMDPVDTATYYCVRV DTLNYHYYGMDVWGQGTTVTSS |
| 49H12 | V$_H$42 | 362 | QVQLVQSGAEVKKPGASVKVSCMASGYIFTSY DINWVRQATGQGPEWMGWMNPYSGSTGYAQ NFQGRVTMTRNTSINTAYMELSSLRSEDTAVYY CAKYNWNYGAFDFWGQGTMVTVSS |
| 51A8 | V$_H$58 | 363 | QVQLVESGGGVVQPGRSLRLSCAASGFTFSSYG MHWVRQAPGKGLEWVAVISYDGSNKYYADSV KGRFTISRDNSKNTLYLQMNSLRAEDTAVYYC ARADGDYPYYYYYGMDVWGQGTTVTVSS |
| 51C10.1 59D10v1 59D10v2 | V$_H$54 | 364 | EVQLLESGGGLVQPGGSLRLSCAASGFTFRNYA MSWVRQAPGKGLEWVSGISGSSAGTYYADSVK GRFTISRDNSKNTLFLQMDSLRAEDTAVYYCAQ DWSIAVAGTFDYWGQGTLVTVSS |
| 51C10.2 | V$_H$67 | 365 | QVQLQESGPGLVKPSQTLSLTCTVSGGSISSGGY YWSWIRQHPGKGLEWIGYIYYNGSPYDNPSLK RRVTISIDASKNQFSLKLSSMTAADTAVYYCAR GALYGMDVWGQGTTVTVSS |
| 51E5 | V$_H$74 | 366 | QVQLQQWGAGLLKPSETLSLTCAVYGGSFSGY YWSWIRQPPGKGLEWIGELDHSGSINYNPSLKS RVTISVDTSKNQFSLKLTSVTAADTAVYYCARV LGSTLDYWGQGTLVTVSS |
| 51G2 | V$_H$50 | 367 | EVQLVESGGGLVKPGGSLRLSCAASGFTFSSYS MNWVRQAPGKGLEWVSSISSSSTYIYYADSVK GRFTISRDNAKNSLYLQMNSLRAEDTAVYYCA RDTYISGWNYGMDVWGQGTTVTVSS |
| 52A8 | V$_H$40 | 368 | QVQLVQSGAEVKKPGASVKVSCKASGYTFTGY YLHWVRQAPGQGLEWMGWINPNSAATNYAPK FQGRVTVTRDTSISTAYMELSRLRSDDTAVYYC AREGGTYNWFDPWGQGTLVTVSS |
| 52B8 | V$_H$77 | 369 | QVQLQESGPGLMKPSETLSLTCTVSGGSISYYY WSWIRQSPGKGLEWIGYIYYSGSTNYNPSLKSR VTMSVDTSKNQFSLKLSSVTAADTAVYYCASG TRAFDIWGQGTMVTVSS |
| 52C1 | V$_H$64 | 370 | QVQLVESGGGVVQPGRSLRLSCAASGFTFSSYG MHWVRQAPGKGLEWVAVIWYDGSNNYYADS VKGRFTISRDNSKSTLFLQMNSLRAEDTAIYYC ARDRAGASPGMDVWGQGTTVTVSS |
| 52F8 | V$_H$41 | 371 | QVQLVQSGAEVKKPGASVKVSCKASGFTFIGY YTHWVRQAPGQGLEWMGWINPSSGDTKYAQK FQGRVTLARDTSISTAYMELSRLRSDDTAVYYC ANSGWYPSYYYGMDVWGQGTTVTVSS |
| 52H2 | V$_H$79 | 372 | QVQLQESGPGLVKPSETLSLTCTVSGGSISTYY WSWIRQPPGTGLEWIGYIFYNGNANYSPSLKSR VTFSVDTSKNQFSLKLSSVTAADTAVYFCARET DYGDYARPFEYWGQGTLVTVSS |
| 53F6 | V$_H$60 | 373 | QVQLVESGGGVVQPGRSLRLSCAASGFTFSTYG MHWVRQAPGKGLEWVAVIWYDGSNKYYADS VKGRFTISRDNSKNTLYLQMNSLRAEDTAVYY CARGHYDSSGPRDYWGQGTLVTVSS |
| 53H5.2 | V$_H$59 | 374 | QVQLVESGGGVVQPGRSLRLSCAASGFTFSSYG MHWVRQAPGQGLEWVALISYDGSNKYYADSV KGRFTISRDKSKNTLYLQMNSLRAEDTAVYYC AREANWGYNYYGMDVWGQGTTVTVSS |
| 53H5.3 | V$_H$75 | 375 | QVQLQQWGAGLLKPSETLSLTCAVYGGSFSDY YWNWIRQPPGKGPEWIGEINHSGTTNYNPSLKS RVTISVDTSKNQFSLKLSSVTAADTAVYYCVGI LRYFDWLEYYFDYWGQGTLVTVSS |

TABLE 2B-continued

Exemplary Antibody Variable Heavy (V<sub>H</sub>) Chains

| Contained in Clone | Designation | SEQ ID NO. | Amino Acid Sequence |
|---|---|---|---|
| 54A1 55G9 | V<sub>H</sub>43 | 376 | QVQLVQSGAEVKKPGASVKVSCKASGYTFTSY DINWVRQATGQGLEWMGWMNPHSGNTGYAQ KFQGRVTMTRNTSINTAYMELSSLRSEDTAVYY CAKYNWNYGAFDFWGQGTMVTVSS |
| 54H10.1 55D1 48H3 53C11 | V<sub>H</sub>52 | 377 | EVQLLESGGGLVQPGGSLRLSCAASGFTFSSYA MSWVRQAPGKGLEWVSAISGSGRTTYSADSVK GRFTISRDNSKNTLYLQMNSLRAEDTAVYYCA KEQQWLVYFDYWGQGTLVTVSS |
| 55D3 | V<sub>H</sub>68 | 378 | QVQLQESGPGLVKPSQTLSLTCTVSGGSITSGVY YWNWIRQHPGKGLEWIGYLYYSGSTYYNPSLK SRLTISADMSKNQFSLKLSSVTVADTAVYYCAR DGITMVRGVTHYYGMDVWGQGTTVTVSS |
| 55E4 49B11 50H10 53C1 52C5 60G5.1 | V<sub>H</sub>70 | 379 | QVQLQQWGAGLLKPSETLSLTCAVYGGSFSGY YWSWIRQPPGKGLEWIGEINHSENTNYNPSLKS RVTISLDTSNDQFSLRLTSVTAADTAVYYCARV TGTDAFDFWGQGTMVTVSS |
| 55E9 | V<sub>H</sub>65 | 380 | QVQLVESGGGVVQPGRSLRLSCAASGFTFSSFG MHWVRQAPGKGLEWVALIWYDGDNKYYADS VKGRFTISRDNSKNTLYLQMNSLRAEDTAVYY CARNSGWDYFYYYGMDVWGQGTTVTVSS |
| 55G5 | V<sub>H</sub>78 | 381 | QVQLQESGPGLVKPSETLSLTCTVSGGSISSYYW SWIRQPAGKGLEWIGRIYISGSTNYNPSLENRVT MSGDTSKNQFSLKLNSVTAADTAVYYCAGSGS YSFDYWGQGTLVTVSS |
| 50G1 | V<sub>H</sub>84 | 382 | QVQLVESGGGVVQPGRSLRLSCAASGFTFSSYG LHWVRQAPGKGLEWVAVIWNDGSNKLYADSV KGRFTISRDNSKNTLYLQMNSLRAEDTAVYYC ARDQYYDFWSGYPYYHYYGMDVWGQGTTVT VSS |
| 56A7 56E4 | V<sub>H</sub>51 | 383 | EVQLVESGGGLVKPGGSLRLSCAASGFTFSSYS MNWVRQAPGKGLEWVSSISSSSTYIYYADSVK GRFTISRDNAKNSLYLQMNSLRAEDTAVYYCA RDIYSSGWSYGMDVWGQGTTVTVSS |
| 56C11 | V<sub>H</sub>61 | 384 | QVQLVESGGGVVQPGRSLRLSCAASGFTFSSYG MHWVRQAPGKGLEWVAVIWYDGSYQFYADS VKGRFTISRDNSKNTLYLQMNSLRAEDTAVYY CARDHVWRTYRYIFDYWGQGTLVTVSS |
| 56E7 | V<sub>H</sub>81 | 385 | EVQLVQSGPEVKKPGESLKISCKGSGYSLTSYWI GWVRQMPGKGLEWMGIIYPGDSDTRYSPSFQG QVTISADTSISTAYLQWSRLKASDTAVYYCARA QLGIFDYWGQGTLVTVSS |
| 56G1 | V<sub>H</sub>71 | 386 | QVQLQQWGAGLLKPSETLSLTCAVYGGSFSGY YWSWIRQPPGKGLEWIGEINHSENTNYNPSLKS RVTISLDTSNKQFSLRLTSVTAADTAVYYCARV TGTDAFDFWGQGTMVTVSS |
| 56G3.3 55B10 | V<sub>H</sub>76 | 387 | QLQLQESGPGLVKPSETLSLTCTVSGDSISSSSY YWGWIRQPPGKGLEWIGMIYYSGTTYYNPSLK SRVTISVDTSKNQFSLKLSSVTAADTAVYYCAR VAAVYWYFDLWGRGTLVTVSS |
| 57B12 | V<sub>H</sub>69 | 388 | QVQLQESGPGLVKPSQTLSLTCTVSGGSITSGVY YWSWIRQLPGKGLEWIGYIYYSGSTYYNPSLKS RLTISADTSKNQFSLKLSSVTVADTAVYYCARD GITMVRGVTHYYGMDVWGQGTTVTVSS |
| 57D9 | V<sub>H</sub>82 | 389 | QVQLQQSGPGLVKPSQTLSLTCAISGDSVSSNSA TWNWIRQSPSRGLEWLGRTYYRSKWYNDYAV SVKSRITINPDTSKNQFSLQLNSVTPEDTAVYYC VGIVVVPAVLFDYWGQGTLVTVSS |

TABLE 2B-continued

Exemplary Antibody Variable Heavy (V_H) Chains

| Contained in Clone | Designation | SEQ ID NO. | Amino Acid Sequence |
|---|---|---|---|
| 58C2 | V_H85 | 390 | QVQLVESGGGVVQPGRSLRLSCAASGFTFSNYG MHWVRQAPGKGLEWVAVIWNDGNNKYYADS VKGRFTISRDNSKNTLYLQMNSLRAEDTAVYY CARDQNYDFWNGYPYYFYYGMDVWGQGTTV TVSS |
| 59A10 49H4 | V_H47 | 391 | QVQVVESGGGLVKPGGSLRLSCAASGFTFSDSY MSWIRQAPGKGLEWISSISSSGSIVYFADSVKGR FTISRDIAKNSLYLHMNSLRAEDTAVYYCARET FSSGWFDAFDIWGQGTMVTVSS |
| 59C9 58A5 57A4 57F9 | V_H49 | 392 | EVQLVESGGGLVKPGGSLRLSCAASGFTFSSYS MSWVRQAPGKGLEWVSSISSSSTYIYYADSLKG RFTISRDNAKNSLFLQVNSLRAEDSAVYYCARD RWSSGWNEGFDYWGQGTLVTVSS |
| 59G10.2 | V_H57 | 393 | QVQLVESGGGVVQPGRSLRLSCAASGFTFSNYG MHWVRQAPGKGLEWVAITSYGGSNKNYADSV KGRFTISRDNSKNTLYLQMNSLRAEDTAVYYC AREAGYSFDYWGQGTLVTVSS |
| 59G10.3 | V_H53 | 394 | EVQLLGSGGGLVQPGGSLRLSCAASGFTFNHYA MSWVRQAPGKGLEWVSAISGSGAGTFYADSM KGRFTISRDNSENTLHLQMNSLRAEDTAIYYCA KDLRIAVAGSFDYWGQGTLVTVSS |
| 60D7 | V_H66 | 395 | QVQLVESGGGVVQPGRSLRLSCAASGFNFSSYG MHWVRQAPGKGLEWVAVIWYDGSNKYYADS VKGRFTISRDNSKNTLYLQMNSLRAEDTAVFYC ARDQYFDFWSGYPFFYYYGMDVWGQGTTVTV SS |
| 60F9 48B4 52D6 | V_H55 | 396 | EVQLLESGGGLVQPGGSLRLSCAASGFTFSSYA MSWVRQAPGKGLEWVSVISDSGGSTYYADSVK GRFTISRDNSKNTLYLQMNSLRAEDTAVYYCA KDHSSGWYYYGMDVWGQGTTVTVSS |
| 60G5.2 | V_H45 | 397 | QVQLVQSGAEVKTPGASVRVSCKASGYTFTNY GISWVRQAPGQGLEWMGWISAYNGYSNYAQK FQDRVTMTTDTSTSTAYMELRSLRSDDTAVYY CAREEKQLVKDYYYYGMDVWGQGSTVTVSS |
| 61G5 | V_H56 | 398 | EVQLLESGGGLVQPGGSLRLSCAASGFTFSSYA MSWVRQSPGKGLEWVSVISGSGGDTYYADSVK GRFTISRDNSKNTLYLQMNSLRAEDTAVYYCA KDHTSGWYYYGMDVWGQGTTVTVSS |
| 56G3.2 | V_H80 | 399 | QVQLQESGPGLVKPSETLSLTCTVSDGSISSYYW NWIRQPAGKGLEWIGRIYTSGSTNYNPSLKSRV TMSVDTSKNQFSLNLTSVTAADTAVYYCARGP LWFDYWGQGTLVTVSS |
| 48G4 53C3.1 | V_H83 | 400 | QVQLVQSGAEVKKPGASVKVSCKVSGYTLTEL SIHWVRQAPGKGLEWMGGFDPEDGETIYAQKF QGRVTMTEDTSTDTAYMELSSLRSEDTAVYYC ATHSGSGRFYYYYGMDVWGQGTTVTVSS |
| 61H5 52B9 | V_H86 | 401 | QLQLQESGPGLVKPSETLSLTCTVSGGSISSSSY YWGWIRQPPGKGLEWIGSIYYSGTTYYNPSLKS RVTISVDTSKNQFSLKLSSVTAADTAVYYCARV AAVYWYFDLWGRGTLVTVSS |
| 50D4 | V_H87 | 402 | QVQLVQSGAEVKKTGASVKVSCKASGYTFTSH DINWVRQATGHGLEWMGWMNPYSGSTGLAQR FQDRVTMTRNTSISTAYMELSSLRSEDTAVYYC ARDLSSGYYYYGLDVWGQGTTVTVSS |
| 50G5v1 50G5v2 | V_H88 | 403 | QVQLVQSGAEVKKPGASVKVSCKASGYPFIGY YMHWVRQAPGQGLEWMGWINPDSGGTNYAQ KFQGRVTMTRDTSITTAYMELSRLRSDDTAVFY CARGGYSYGYEDYYGMDVWGQGTTVTVSS |

TABLE 2B-continued

Exemplary Antibody Variable Heavy (V$_H$) Chains

| Contained in Clone | Designation | SEQ ID NO. | Amino Acid Sequence |
|---|---|---|---|
| 51C1 | V$_H$89 | 404 | QVQLQQWGAGLLKPSETLSLTCAVYGGSFSGY YWSWIRQPPGKGLEWIGEINHSENTNYNPSLKS RVTISLDTSHDQFSLRLTSVTAADTAVYYCARV TGTDAFDFWGQGTMVTVSS |
| 53C3.2 | V$_H$90 | 405 | QVQLQESGPGLVKPSQTLSLTCTVSNGSINSGN YYWSWIRQHPGKGLEWIGYIYHSGSAYYNPSL KSRVTISVDTSKNQFSLKLSSVTAADTAVYYCA RTTGASDIWGQGIMVTVSS |
| 54H10.3 | V$_H$91 | 406 | DIQMTQSPSSLSASVGDRVTITCRASQTISIYLN WYQQKPGKAPKFLIYSASSLQSGVPSRFSGSGS GTDFTLTISSLQPEDFSTYFCQQSYSSPLTFGGGT KVEIKR |
| 55A7 | V$_H$92 | 407 | QVQLQESGPGLVKPSETLSLTCTVSGGSISSYYW SWIRQPPGKGLEWIGYIYYSGSTNYNPSLKSRVT ISVDTSKNQFSLRLSSVTAADTAVYYCARGITGT IDFWGQGTLVTVSS |
| 55E6 | V$_H$93 | 408 | EVQLVESGGGLVQPGGSLRLSCAASGFTFSSYS MNWVRQAPGKGLEWISYISSGSSTIYHADSVKG RFTISRDNAKNSLYLQMNSLRDEDTAVYYCAR EGYYDSSGYYYNGMDVWGQGTTVTVSS |
| 61E1 | V$_H$94 | 409 | QVQLQQSGPGLVKPSQTLSLTCAISGDSVSSNSA AWNWIRQSPSRGLEWLGRTYYRSKWYNDYAV SVKSRITITPDTSKNQFSLQLKSVTPEDTAIYYCA REGSWSSFFDYWGQGTLVTVSS |

TABLE 2C

Coding Sequence for Antibody Variable Light (V$_L$) Chains

| Contained in Clone | Designation | SEQ ID NO. | Coding Sequence |
|---|---|---|---|
| 63E6 | V$_L$6 | 410 | GACATCCAGATGACCCAGTCTCCATCCTCCCTGT CTGCATCTGTAGGAGACAGAGTCACCATCACTT GCCGGACAAGTCAGAGTATTAGCAGCTATTTAA ATTGGTATCAGCAGAAACCAGGGAAAGCCCCTA ACCTCCTGATCTATGCTGCATCCAGTTTGCAAAG TGGGGTCCCATCAAGATTCAGTGGCAGTGGATC TGGGACAGATTTCACTCTCACCATCAGCGGTCTG CAACCTGAAGATTTTTCAACTTACTACTGTCAAC AGAGTTACAGTACCTCGCTCACTTTCGGCGGAG GGACCAAGGTGGAGATCAAACGA |
| 66D4 | V$_L$18 | 411 | GACATCCAGATGACCCAGTCGCCATCCTCCCTGT CTGCATCTGTAGGAGACAGGATCACCATCACTT GCCGGGCAAGTCAGATCATTAGCAGGTATTTAA ATTGGTATCAGCAGAACCCAGGGAAAGCCCCTA AGCTCCTGATCTCTGCTGCATCCAGTTTGCAAAG TGGAGTCCCATCAAGGTTCAGTGGCAGTGGATC TGGGCCAGATTTCACTCTCACCATCAGCAGTCTG CAACCTGAAGATTTTACAACTTACTACTGTCAAC AGAGTTACAGTTCCCCGCTCACTTTCGGCGGAG GGACCAAGGTGGAGGTCAAACGA |
| 66B4 | V$_L$11 | 412 | GACATCCAGATGACCCAGTCTCCATCTTCCGTGT CTTCATCTGTAGGAGACAGAGTCACCATCACTT GTCGGGCGAGTCAGGGTATTAGCAGGTGGTTAG CCTGGTATCAGCAGAAACCAGGGAAAGCCCCTA AGCTCCTGATCTATGCTGCATCCAGTTTGAAAAG TGGGGTCCCATCAAGGTTCAGCGGCAGTGGATC TGGGACAGATTTCACTCTCACCATCAGCAGCCT GCAGCCTGAAGATTTTGCAACTTACTATTGTCAA CAGGCTAACAGTTTCCCTCCGACGTTCGGCCAA GGGACCAAGGTGGAAATCAAACGA |

TABLE 2C-continued

Coding Sequence for Antibody Variable Light (V_L) Chains

| Contained in Clone | Designation | SEQ ID NO. | Coding Sequence |
|---|---|---|---|
| 65B1 | V_L19 | 413 | GACATCCAGATGACCCAGTCTCCATCCTCCCTGT<br>CTGCATCTGTAGGAGACAGAGTCACCATCACTT<br>GCCGGGCAAGTCAGAACATTAACAACTATTTAA<br>ATTGGTATCGGCAGAAACCAGGGAAAGCCCCTG<br>AACTCCTGATCTATACTACATCCAGTTTGCAAAG<br>TGGGGTCCCATCAAGGTTCAGTGGCAGTGGATC<br>TGGGACAGATTTCACTCTCACCATCAGCAGTCTG<br>GAAACTGAAGATTTTGAAACTTACTACTGTCAA<br>CAGAGTTACAGTACCCCTCTCACTTTCGGCGGA<br>GGGACCAAGGTGGAGATCAAACGA |
| 65B4 | V_L21 | 414 | TCCTATGTGCTGACTCAGCCACCCTCGGTGTCAG<br>TGGCCCCAGGACAGACGGCCAGGATTACCTGTG<br>GGGGAAACAACATTGGAAGTAAAAGTGTGCAGT<br>GGTACCAGCAGAAGCCAGGCCAGGCCCCTGTGC<br>TGGTCGTCTACGATGATAGCGACCGGCCCTCAG<br>GGATCCCTGAGCGATTCTCTGGCTCCAACTCTGG<br>GAACACGGCCTCCCTGACCATCAGCAGGGTCGA<br>AGCCGGGGATGAGGCCGACTATTACTGTCAGGT<br>GTGGGATAGTAGTAGTGATCATGTGGTATTCGG<br>CGGAGGGACCAAGCTGACCGTCCTAGGT |
| 67A4 | V_L20 | 415 | TCCTATGTGCTGACTCAGCCACCCTCGGTGTCAG<br>TGGCCCCAGGACAGACGGCCAGGATTACCTGTG<br>GGGGAAACAACATTGGAAGTAAAAGTGTGCACT<br>GGTACCAGCAGAAGCCAGGCCAGGCCCCTGTGC<br>TGGTCGTCTATGATGATAGCGACCGGCCCTCAG<br>GGATCCCTGAGCGATTCTCTGGCTCCAACTCTGG<br>GAACACGGCCACCCTGACCATCAGCAGGGTCGA<br>AGCCGGGGATGAGGCCGACTATTACTGTCAGGT<br>GTGGGATAGTAGTAGTGATCATGTGGTATTCGG<br>CGGAGGGACCAAGCTGACCGTCCTAGGT |
| 63A10v1 | V_L22 | 416 | TCCTATGAGCTGACTCAGCCACACTCAGTGTCA<br>GTGGCCACAGCACAGATGGCCAGGATC<br>ACCTGTGGGGGAAACAACATTGGAAGTAAAGCT<br>GTGCACTGGTACCAGCAAAAGCCAGGC<br>CAGGACCCTGTGCTGGTCATCTATTGCGATAGC<br>AACCGGCCCTCAGGGATCCCTGAGCGA<br>TTCTCTGGCTCCAACCCAGGGAACACCGCCACC<br>CTAACCATCAGCAGGATCGAGGCTGGG<br>GATGAGGCTGACTATTACTGTCAGGTGTGGGAC<br>AGTAGTAGTGATGGGTATTCGGCGGA<br>GGGACCAAGCTGACCGTCCTAGGT |
| 63A10v2 | V_L101 | 1857 | TCCTATGAGCTGACTCAGCCACACTCAGTGTCA<br>GTGGCCACAGCACAGATGGCCAGGATC<br>ACCTGTGGGGGAAACAACATTGGAAGTAAAGCT<br>GTGCACTGGTACCAGCAAAAGCCAGGC<br>CAGGACCCTGTGCTGGTCATCTATTGCGATAGC<br>AACCGGCCCTCAGGGATCCCTGAGCGA<br>TTCTCTGGCTCCAACCCAGGGAACACCGCCACC<br>CTAACCATCAGCAGGATCGAGGCTGGG<br>GATGAGGCTGACTATTACTGTCAGGCGTGGGAC<br>AGCACCACTGTGGTATTCGGCGGAGGG<br>ACCAAGTTGACCGTCCTAGGT |
| 63A10v3 | V_L102 | 1858 | ACCTGCTCTGGAGATAAATTGGGGAATAGATAT<br>ACTTGCTGGTATCAGCAGAAGTCAGGC<br>CAGTCCCCTGTGCTGGTCATCTATCAAGATAGCG<br>AGCGGCCCTCAGGGATCCCTGAGCGA<br>TTCTCTGGCTCCAACTCTGGGAACACAGCCACTC<br>TGACCATCAGCGGGACCCAGGCTATG<br>GATGAGGCTGACTATTACTGTCAGGCGTGGGAC<br>AGCACCACTGTGGTATTCGGCGGAGGG<br>ACCAAGTTGACCGTCCTAGGT |
| 65H11v1 | V_L23 | 417 | TCCTATGAGCTGACTCAGCCACACTCAGTGTCA<br>GTGGCCACAGCACAGATGGCCAGGATCACCTGT<br>GGGGGAAACAACATTGGAAGTAAAACTGTGCAC<br>TGGTTCCAGCAAAAGCCAGGCCAGGACCCTGTG<br>CTGGTCATCTATAGCGATAGCAACCGGCCCTCA<br>GGGATCCCTGAGCGATTCTCTGGCTCCAACCCA<br>GGGAACACCGCCACCCTAACCATCAGCAGGATC<br>GAGGCTGGGGATGAGGCTGACTATTACTGTCAG |

TABLE 2C-continued

Coding Sequence for Antibody Variable Light (V$_L$) Chains

| Contained in Clone | Designation | SEQ ID NO. | Coding Sequence |
|---|---|---|---|
| | | | GTGTGGGACAGTAGTTGTGATGGGGTATTCGGC GGAGGGACCAAGCTGACCGTCCTAGGT |
| 65H11v2 | V$_L$103 | 1859 | TCCTATGAGCTGACTCAGCCACCCTCAGTGTCCG TGTCCCCAGGACAGACAGCCAACATC ACCTGCTCTGGAGATAAATTGGGGGATAGATAT GTTTGTTGGTATCAGCAGAAGCCAGGC CAGTCCCCTGTGCTGGTCATCTATCAAGATAGCA AGCGGCCCTCAGGGATCCCTGAACAA TTCTCTGGCTCCAACTCTGGGAACACAGCCACTC TGACCATCAGCGGGACCCAGGCTATA GATGAGGCTGACTATTACTGTCAGGCGTGGGAC AGCATCACTGTGGTATTCGGCGGAGGG ACCAAGCTGACCGTCCTAGGT |
| 67G10v1 | V$_L$9 | 418 | TCCTATGAGCTGACTCAGCCACACTCAGTGTCA GTGGCCACAGCACAGATGGCCAGGATCACCTGT GGGGGAAACAACATTGGAAGTAAAGCTGTGCAC TGGTACCAGCAAAAGCCAGGCCAGGACCCTGTG CTGGTCATCTATAGCGATAGCAACCGGCCCTCA GGGATCCCTGAGCGATTCTCTGGCTCCAACCCA GGGAACACCGCCACCCTAACCATCAGCAGGATC GAGGCTGGGGATGAGGCTGACTATTACTGTCAG GTGTGGGACAGTAGTAGTGATGGGGTATTCGGC GGAGGGACCAAGCTGACCGTCCTAGGT |
| 67G10v2 | V$_L$10 | 419 | TCCTATGAGCTGACTCAGCCACCCTCAGTGTCCG TGTCCCCAGGACAGACAGCCAGCATCACCTGCT CTGGAGATAAATTGGGGGATAAATATGCTTGCT GGTATCAGCAGAAGCCAGGCCAGTCCCCTGTGC TGGTCATCTATCAAGATAACGAGCGGCCCTCAG GGATCCCTGAGCGATTCTCTGGCTCCAACTCTGG GAACACAGCCACTCTGACCATCAGCGGGACCCA GGCTATGGATGAGGCTGACTATTACTGTCAGGC GTGGGACAGCACCACTGTGGTATTCGGCGGAGG GACCAAGCTGACCGTCCTAGGT |
| 64C8 | V$_L$24 | 420 | GATGTTGTGATGACTCAGTCTCCGCTCTCCCTGC CCGTCACCCTTGGACAGCCGGCCTCCATCTCCCG CAGGTCTAGTCCAAGCCTCGTATACAGTGATGG AAACACCTACTTGAATTGCTTTCAGCAGAGGCC AGGCCACTCTCCAAGGCGCCTAATTTATAAGGG TTCTAACTGGGACTCAGGGGTCCCAGACAGATT CAGCGGCAGTGGGTCAGGCACTGATTTCACTCT GAAAATCAGCAGGGTGGAGGCTGAGGATGTTGG TATTTATTACTGCATACAAGATACACACTGGCCC ACGTGCAGTTTTGGCCAGGGGACCAAGCTGGAG ATCAAACGA |
| 64A8 67B4 | V$_L$1 | 421 | GACATCCAGATGACCCAGTCTCCATCCTCCCTGT CTGCATCTGTAGGAGACAGAGTCACCATCACTT GCCGGGCAAGTCAGGACATTAGAAATGATTTAG GCTGGTATCAGCAGAAACCAGGGAAAGCCCCTA AGCGCCTGATCTATGCTGCATCCAATTTGCAAA GGGGGGTCCCATCAAGGTTCAGCGGCAGTGGAT CTGGGACAGAATTCACTCTCACAATCAGCACCC TGCAGCCTGAAGATTTTGCAACTTATTCCTGTCT CCAGCATAATAGTTACCCTCTCACTTTCGGCGGA GGGACCAAGGTGGAGATCAAACGA |
| 63G8v1 | V$_L$104 | 1860 | GACATCCAGATGACCCAGTCTCCATCCTCCCTGT CTGCATCTGTAGGAGACAGAGTCACC ATCACTTGCCGGGCAAGTCAGGACATTAGAAAT GATTTAGGCTGGTATCAACAGAAACCA GGGAAAGCCCCTAAGCGCCTGATCTATGCTGCA TCCAATTTGCAAAGGGGGGTCCCATCA AGGTTCAGCGGCAGTGGATCTGGGACAGAATTC ACTCTCACAATCAGCACCCTGCAGCCT GACGATTTTGCAACTTATTCCTGTCTCCAGCATA ATAGTTACCCTCTCACTTTCGGCGGA GGGACCAAGGTGGAGATCAAACGA |
| 63G8v2 | V$_L$105 | 1861 | GACATCCAGATGACCCAGTCTCCATCCTCCCTGT CTGCATCTGTAGGAGACAGAGTCACC ATCACTTGCCGGGCAAGTCAGGGCATTAGAAGT |

TABLE 2C-continued

Coding Sequence for Antibody Variable Light ($V_L$) Chains

| Contained in Clone | Designation | SEQ ID NO. | Coding Sequence |
|---|---|---|---|
| | | | GGTTTAGGCTGGTATCAGCAGAAACCA<br>GGGAAAGCCCCTAAGCGCCTGATCTATGCTGCA<br>TCCAATTTGCAAAGGGGGGTCCCATCA<br>AGGTTCAGCGGCAGTGGATCTGGGACAGAATTC<br>ACTCTCACAGTCAGCAGTCTGCAGCCT<br>GAAGATTTTGCAACTTATTCCTGTCTCCAGCATA<br>ATAGTTACCCTCTCACTTTCGGCGGA<br>GGGACCAAGGTGGAGATCAAACGA |
| 63G8v3 | $V_L$106 | 1862 | GACATCCAGATGACCCAGTCTCCATCCTCCCTGT<br>CTGCATCTGTAGGAGACAGAGTCACC<br>ATCACTTGCCGGGCAAGTCAGGGCATTAGAAGT<br>GGTTTAGGCTGGTATCAACAGAAACCA<br>GGGAAAGCCCCTAAGCGCCTGATCTATGCTGCA<br>TCCAATTTGCAAAGGGGGGTCCCATCA<br>AGGTTCAGCGGCAGTGGATCTGGGACAGAATTC<br>ACTCTCACAGTCAGCAGTCTGCAGCCT<br>GAAGATTTTGCAACTTATTCCTGTCTCCAACATA<br>ATACTTACCCTCTCACTTTCGGCGGA<br>GGGACCAAGGGGGAGATCAGACGA |
| 66G2 | $V_L$12 | 422 | GACATCCAGATGACCCAGTCTCCATCCTCCCTGT<br>CTGCATCTGTAGGAGACAGAGTCACCATCACTT<br>GCCGGGCAAGTCAGGGCATTAGAAATGATTTAG<br>GCTGGTATCAGCAGAAACCAGGGAAAGCCCCTA<br>AGCGCCTGATCTATGCTGCATCCAATTTGCAAA<br>GTGGGGTCCCATCAAGGTTCAGCGGCAGTGGAT<br>CTGGGACAAAATTCACTCTCACAATCAACAGCC<br>TGCAGCCTGAAGATTTTGCAACTTATTACTGTCT<br>ACAACTTAATGGTTACCCTCTCACTTTCGGCGGA<br>GGGACCAAGGTGGAGATCAAACGA |
| 68D3v1<br>68D3v2 | $V_L$2 | 423 | GACATCCAGATGACCCAGTCTCCATCCTCCCTGT<br>CTGCATCTGTAGGAGACAGAGTCACCATCACTT<br>GCCGGGCAAGTCAGGACATTAGAAATGATTTAG<br>GCTGGTATCAACAGAAACCAGGGAAAGCCCCTA<br>AGCGCCTGATCTATGCTGCATCCAATTTGCAAA<br>GGGGGGTCCCATCAAGGTTCAGCGGCAGTGGAT<br>CTGGGACAGAATTCACTCTCACAATCAGCACCC<br>TGCAGCCTGACGATTTTGCAACTTATTCCTGTCT<br>CCAGCATAATAGTTACCCTCTCACTTTCGGCGGA<br>GGGACCAAGGTGGAGATCAAACGA |
| 65D1 | $V_L$27 | 424 | TCCTATGACCTGACTCAGCCACCCTCAGTGTCCG<br>TGTCCCCAGGACAGACAGCCAGCATCACCTGCT<br>CTGGAGATAAATTGGGGGATAAATATGTTTGCT<br>GGTATCAGCAGAAGCCAGGCCAGTCCCCTGTGC<br>TGGTCATCTATCAAGATAGTAAGCGGCCCTCAG<br>GGATCCCTGAGCGATTCTCTGGCTCCAACTCTGG<br>GAACACAGCCACTCTGACCATCAGCGGGATCCA<br>GGCTATGGATGAGGCTGACTATTACTGTCAGGC<br>GTGGGACAGCAGGGTATTCGGCGGAGGGACCA<br>AGCTGACCGTCCTAGGT |
| 65G4<br>64H5 | $V_L$8 | 425 | TCCTATGAGATGACTCAGCCACTCTCAGTGTCAG<br>TGGCCCTGGGACAGACGGCCAGGATTACCTGTG<br>GGGGAAACAACATTGGAAGTAAAAATGTACACT<br>GGTACCAGCAGAAGCCAGGCCAGGCCCCTGTGT<br>TGGTCATCTATAGGGATAGCAAGCGGCCCTCTG<br>GGATCCCTGAGCGATTCTCTGGCTCCAACTCGG<br>GGAACACGGCCACCCTGACCATCAGCAGAGCCC<br>AAGCCGGGGATGAGGCTGACTATTACTGTCAGG<br>TGTGGGACAGCAGTAGTGTGGTATTCGGCGGAG<br>GGACCAAGCTGACCGTCCTAGGT |
| 65D4 | $V_L$26 | 426 | TCCTATGAGCTGACTCAGCCACTCTCAGTGTCTG<br>TGGCCCTGGGCCAGACGGCCAGGATTCCCTGTG<br>GGGGAAATGACATTGGAAGTAAAAATGTGCACT<br>GGTACCAGCAGAAACCAGGCCAGGCCCCTGTGC<br>TGGTCATCTATAGGGATCGCAACCGGCCCTCTG<br>GGATCCCTGAGCGATTCTCTGGCTCCAACTCGG<br>GGAACACGGCCACCCTGACCATCAGCAGAGCCC<br>AAGCCGGGGATGAGGCTGACTATTACTGTCAGG<br>TGTGGGACAGCAACCCTGTGGTATTCGGCGGAG<br>GGACCAAGCTGACCGTCCTAGGT |

TABLE 2C-continued

Coding Sequence for Antibody Variable Light (V_L) Chains

| Contained in Clone | Designation | SEQ ID NO. | Coding Sequence |
|---|---|---|---|
| 65E3 | V_L25 | 427 | TCCTATGAGCTGACTCAGCCACTCTCAGTGTCAG TGGCCCTGGGACAGACGGCCAGGATTACCTGTG GGGGAAACAACATTGGAAGTAAAAATGTGCACT GGTACCAGCAGAAGCCAGGCCAGGCCCCTGTGC TGGTCATCTATAGGGATAGAAACCGGCCCTCTG GGATCCCTGAGCGATTCTCTGGCTCCAACTCGG GGAACACGGCCACCCTGACCATCAGCAGAGCCC AAGCCGGGGATGAGGCTGACTATTACTGTCAGG TGTGGGACAGCAGCACTGTGGTCTTCGGCGGAG GGACCAAGCTGACCGTCCTAGGT |
| 68G5 | V_L13 | 428 | TCCTATGAGCTGACTCAGCCACTCTCAGTGTCAG TGGCCCTGGGACAGACGGCCAGGCTTACCTGTG GGGGTAACAACATTGGAAGTATAAATGTGCACT GGTACCAGCAGAAGCCAGGCCAGGCCCCTGTGT TGGTCATCTATAGGGATAGGAACCGGCCCTCTG GGATCCCTGAGCGATTCTCTGGCTCCAACTCGG GTAACACGGCCACCCTGACCATCAGCAGAGCCC AAGCCGGGGATGAGGCTGACTATTACTGTCAGT TGTGGGACAGCAGCACTGTGGTTTTCGGCGGAG GGACCAAGCTGACCGTCCTAGGT |
| 67G8 | V_L28 | 429 | TCCTATGAGCTGACTCAGCCACTCTCAGTGTCAG TGGCCCTGGGACAGACGGCCAGGATTACCTGTG GGGGAAACAACATTGGAAGTTACAATGTGTTCT GGTACCAGCAGAAGCCAGGCCAGGCCCCTGTGC TGGTCATCTATAGGGATAGCAAGCGGCCCTCTG GGATCCCTGAGCGATTCTCTGGCTCCAACTCGG GGAACACGGCCACCCTGACCATCAGCAGAGCCC AAGCCGGGGATGAGGCTGACTATCACTGTCAGG TGTGGGACAGCAGCACTGTGGTATTCGGCGGAG GGACCAAGCTGACCGTCCTAGGT |
| 65B7v1 | V_L29 | 430 | GAAATTGTGTTGACGCAGTCTCCAGGCACCCTG TCTTTGTCTCCAGGGGAAAGAGCCACC CTCTCCTGCAGGGCCAGTCAGAGTGTTAGCAGC ATCTACTTAGCCTGGTACCAGCAGAAA CCTGGCCAGGCTCCCAGGCTCCTCATCTATGGTG CATCCAGCAGGGCCACTGGCATCCCA GACAGGTTCAGTGGCAGTGGGTCTGGGACAGAC TTCACTCTCACCATCAGCAGACTGGAG CCTGAAGATTTTGCAGTGTATTACTGTCAGCAGT ATGGTAGCTCGTGCAGTTTTGGCCAG GGGACCAAGCTGGAGATCAAACGA |
| 65B7v2 | V_L107 | 1863 | GATGTTGTGATGACTCAGTCTCCACTCTCCCTGC CCGTCACCCTTGGACAGCCGGCCTCC ATCTCCTACAGGTCTAGTCAAAGCCTCGTATACA GTGATGGAGACACCTACTTGAATTGG TTTCAGCAGAGGCCAGGCCAATCTCCAAGGCGC CTAATTTATAAGGTTTCTAACTGGGAC TCTGGGGTCCCAGACAGATTCAGCGGCAGTGGG TCAGGCACTGATTTCACACTGAAAATC AGCAGGGTGGAGGCTGAGGATGTTGGGGTTTAT TACTGCATGCAAGGTACACACTGGCGG GGTTGGACGTTCGGCCAAGGGACCAAGGTGGAA ATCAAACGA |
| 63B6 64D4 | V_L4 | 431 | GAAATTGTGTTGACGCAGTCTCCAGGCACCCTG TCTTTGTCTCCAGGGGAAAGAGCCACCCTCTCCT GCAGGGCCAGTCAGAGTGTTAGTAACAGCTACT TAGCCTGGTACCAGCAGAAACCTGGCCAGGCTC CCAGGCTCCTCATCTATGGTGCATTCAGTAGGGC CACTGGCATCCCAGACAGGTTCAGTGGCAGTGG GTCTGGGACAGACTTCACTCTCACCATCAGCAG ACTGGAGCCTGAAGATTTTGCAGTATATTACTGT CAGCAGTTTGGTAGGTCATTCACTTTCGGCGGA GGGACCAAGGTGGAGATCAGACGA |
| 63F5 | V_L14 | 432 | GAAGTTGTGTTGACGCAGTCTCCAGGCACCCTG TCTTTGTCTCCAGGGGAAAGAGCCACCCTCTCCT GCAGGGCCAGTCAGAGTGTTAGGAACAACTACT TAGCCTGGTACCAGCAGCAACCTGGCCAGGCTC CCAGGCTCCTCATCTTTGGTGCGTCCAGCAGGGC CACTGGCATCCCAGACAGGTTCAGTGGCAGTGG |

TABLE 2C-continued

Coding Sequence for Antibody Variable Light ($V_L$) Chains

| Contained in Clone | Designation | SEQ ID NO. | Coding Sequence |
|---|---|---|---|
| | | | GTCTGGGACAGACTTCACTCTCACCATCAGCAG<br>ACTGGAGCCTGAAGATTTTGCAGTGTATTACTGT<br>CAGCAGTTTGGTAGTTCACTCACTTTCGGCGGAG<br>GGACCAAGGTGGAGATCAAACGA |
| 65E8<br>63H11<br>64E6<br>65F11<br>67G7 | $V_L$3 | 433 | GAAATTGTGTTGACGCAGTCTCCAGGCACCCTG<br>TCTTTGTCTCCAGGGGAAAGAGCCACCCTCTCCT<br>GCAGGGCCAGTCAGAGTGTTAGGAACAGCTACT<br>TAGCCTGGTACCAGCAGCAACCTGGCCAGGCTC<br>CCAGGCTCCTCATCTATGGTGCATTTAGCAGGGC<br>CTCTGGCATCCCAGACAGGTTCAGTGGCAGTGG<br>GTCTGGGACAGACTTCACTCTCACCATCAGCAG<br>ACTGGAGCCTGAAGATTTTGCAGTGTATTACTGT<br>CAGCAGTTTGGAAGCTCACTCACTTTCGGCGGA<br>GGGACCAAGGTGGAGATCAAACGA |
| 65C1 | $V_L$16 | 434 | GAAATTGTGTTGACGCAGTCTCCAGGCACCCTG<br>TCTTTGTCTCCAGGGGAAAGAGCCACCCTCTCCT<br>GCAGGGCCAGTCAGACTATTAGGAACAGCTACT<br>TAGCCTGGTACCAGCAGCAACCTGGCCAGGCTC<br>CCAGGCTCCTCATCTATGGTGCATTCAGCAGGG<br>CCACTGGCATCCCAGACAGGTTCAGTGGCGGTG<br>GGTCTGGGACAGACTTCACTCTCACCATCAGCA<br>GACTGGAGCCTGAAGATTTTGCAGTGTATTACT<br>GTCAGCAGTTTGGTAGCTCACTCACTTTCGGCGG<br>AGGGACCAAGGTGGAGATCAAACGA |
| 66F6 | $V_L$15 | 435 | GAAATTGTGTTGACGCAGTCTCCAGGCACCCTG<br>TCTTTGTCTCCAGGGGAAAGAGCCACCCTCTCCT<br>GCAGGGCCAGTCAGAGTGTTAGGAACAGCTACT<br>TAGCCTGGTACCAGCAGCAACCTGGCCAGGCTC<br>CCAGGCTCCTCATCTATGGTGCATTCAGCAGGG<br>CCACTGGCATCCCAGACAGGTTCAGTGGCAGTG<br>GGTCTGGGACAGACTTCACTCTCACCATCAGCA<br>GACTGGAGCCTGAAGATTTTGCAGTGTATTACT<br>GTCAGCAGTTTGGTAGCTCACTCACTTTCGGCGG<br>AGGGACCAAGGTGGAGATCAAACGA |
| 64A6 | $V_L$30 | 436 | GAAATACTGATGACGCAGTCTCCAGCCACCCTG<br>TCTGTGTCTCCAGGGGAAAGAGCCACCCTCTCCT<br>GCAGGGCCAGTCAGAGTGTTAACAGCAACTTAG<br>CCTGGTACCAGCAGAAACCTGGCCAGGCTCCCA<br>GGCTCCTCATCTATGGTACATCCACCAGGGCCA<br>CTGGTGTCCCAGCCAGGTTCGGTGGCAGTGGGT<br>CTGGGACAGAATTCACTCTCACCATCAGCAGCC<br>TGCAGTCTGAAGATTTTGCATTTTATTACTGTCA<br>GCAATATAATACCTGGCCGTGGACGTTCGGCCA<br>AGGGACCAAGGTGGAAATCAAACGA |
| 65F9 | $V_L$31 | 437 | GAAATACTGATGACGCAGTCTCCAGCCACCCTG<br>TCTGTGTCTCCAGGGGAAAGAGCCACCCTCTCCT<br>GCAGGGCCAGTCAGAGTGTTAGCAGCAACTTAG<br>CCTGGTACCAGCAGAAACCTGGCCAGTCTCCCA<br>GGCTCCTCATCTATGGTGCATCCACCAGGGCCA<br>CTGGTATCCCAGCCAGGTTCGGTGGCAGTGGGT<br>CTGGGACAGACTTCACTCTCACCATCAGCAGCC<br>TGCAGTCTGAAGATTTTGCATTTTATTACTGTCA<br>GCAGTATAATACCTGGCCGTGGACGTTCGGCCA<br>AGGGACCAAGGTGGAAATCAAACGA |
| 64A7 | $V_L$17 | 438 | GAAATTGTATTGACGCAGTCTCCAGGCACCCTG<br>TCTTTGTCTCCAGGGGAAAGAGCCACCCTCTCCT<br>GCAGGGCCAGTCAGAGTGTTAGTCGCAACTACT<br>TAGCCTGGTACCAGCAGAAACCTGGCCAGGCTC<br>CCAGGCTCCTCATCTATGGTGCATCCAGCAGGG<br>CCACTGGCGTCCCAGACAGGTTCAGTGGCAGTG<br>GGTCTGGGACAGACTTCACTCTCACCATCAGCA<br>GACTGGAGCCTGAAGATTTTGCAGTGTATTACT<br>GTCAGCAGTATGGTAGTTCATCTCTGTGCAGTTT<br>TGGCCAGGGGACCAACCTGGACATCAGACGA |
| 65C3<br>68D5 | $V_L$5 | 439 | GAAATGGTGATGACGCAGTCCCCAGCCACCCTG<br>TCTGTGTCTCCAGGGGAAAGAGCCACCCTCTCCT<br>GCAGGGCCAGTCAGAGTGTTAGCAGCAGTTAG<br>CCTGGTACCAGGAGAAACCTGGCCGGGCTCCCA |

TABLE 2C-continued

Coding Sequence for Antibody Variable Light (V_L) Chains

| Contained in Clone | Designation | SEQ ID NO. | Coding Sequence |
|---|---|---|---|
| | | | GGCTCCTCATCTATGGTGCCTCCAACAGGGCCAT TGATATCCCAGCCAGGTTAAGTGGCAGTGGGTC TGGGACAGAGTTCACTCTCACCATCAGCAGCCT GCAGTCTGAAGATTTTGCTGTTTATTACTGTCAG CAGTATAATAACTGGCCGTGGACGTTCGGCCAA GGGACCAAGGTGGAATTCAAACGA |
| 67F5 | V_L32 | 440 | GAAATAGTGATGACGCAGTCTCCAGCCACCCTG TCTGTGTCTCCAGGGGAAAGAGTCACCCTCTCCT GCAGGGCCAGTCAGAGTGTTAGCAGCAACTTAG CCTGGTACCAGCAGAAACCTGGCCAGGCTCCCA GGCTCCTCATACATGGTTCATCCAACAGGGCCA TTGGTATCCCAGCCAGGTTCAGTGGCAGTGGGT CTGGGACAGAGTTCACTCTCACCATCAGCAGCC TGCAGTCTGCAGATTTTGCTGTTTATAACTGTCA GCAGTATGAAATTTGGCCGTGGACGTTCGGCCA AGGGACCAAGGTGGAAATCAAACGA |
| 64B10v1 64B10v2 | V_L33 | 441 | CAGTCTGTGTTGACGCAGCCGCCCTCAGTGTCTG CGGCCCCAGGACAGAAGGTCACCATCTCCTGCT CTGGAAGCAGCTCCAATATTGGGAATAATTATG TAGCCTGGTACCAGCAGCTCCCAGGAACAGCCC CCAAACTCCTCATTTATGACAATGATAAGCGAC CCTCAGGGATTCCTGACCGATTCTCTGGCTCCAA GTCTGGCACGTCAGCCACCCTGGGCATCACCGG ACTCCAGACTGGGGACGAGGCCGATTATTACTG CGGAACATGGGATAGCAGCCTGAGTGCTGTGGT ATTCGGCGGAGGGACCAAGCTGACCGTCCTAGGT |
| 68C8 | V_L34 | 442 | CAGTCTGTGTTGACGCAGCCGCCCTCAGTGTCTG CGGCCCCAGGACAGAAGGTCACCATCTCCTGCT CTGGAAGCAGTTCCAACATTGGAAATAATTATG TATCCTGGTACCAGCAGCTCCCAGGAACAGCCC CCAAACTCCTCATTTATGACAATAATAAGCGAC CCTCAGGGATTCCTGACCGATTCTCTGGCTCCAA GTCTGGCACGTCAGCCACCCTGGGCATCACCGG ACTCCAGACTGGGGACGAGGCCGATTATTACTG CGGAACATGGGATAGCAGCCTGAGTGCTGTGGT ATTCGGCGGAGGGACCAAACTGACCGTCCTAGGT |
| 67A5 | V_L35 | 443 | GATATTGTGATGACCCAGACTCCACTCTCCCTGC CCGTCACCCCTGGAGAGCCGGCCTCCATCTCCTG CAGGTCTAGTCAGAGCCTCTTAAATAGTGATGA TGGAAATACCTATTTGGACTGGTACCTGCAGAA GCCAGGGCAGTCTCCACAACTCCTGATCTATAC GCTTTCCTATCGGGCCTCTGGAGTCCCAGACAG GTTCAGTGGCACTGGGTCAGGCACTGAATTCAC ACTGAAAATCAGCAGGGTGGAGGCTGAGGATGT TGGAGTTTATTACTGCATGCAACGTCTAGAGTTT CCTATTACCTTCGGCCAAGGGACACGACTGGAG ATTAAACGA |
| 67C10 | V_L36 | 444 | GATTTTGTGATGACCCAGACTCCACTCTCCCTGC CCGTCACCCCTGGAGAGCCGGCCTCCATCTCCTG CAGGTCTAGTCAGAGCCTCTTAAATAGTGATGA TGGAAACACCTATTTGGACTGGTACCTGCAGAA GCCAGGGCAGTCTCCACAGCTCCTGATCTATAC GCTTTCCTATCGGGCCTCTGGAGTCCCAGACAG GTTCAGTGGCAGTGGGTCAGGCACTGATTTCAC ACTGAAAATCAGCAGGGTGGAGGCTGAGGATGT TGGAGTTTATTACTGCATGCAACGTATAGAGTTT CCTATCACCTTCGGCCAAGGGACACGACTGGAG ATTAAACGA |
| 64H6 | V_L37 | 445 | TCCTACGAGCTGACTCAGCCACTCTCAGTGTCAG TGGCCCTGGGACAGACGGCCAGGATTACCTGTG GGGGAAACAACATTGGAAGTAAAAATGTGCACT GGTACCAGCAGAAGCCAGGCCAGGCCCCTGTGG TGGTCATCTATAGGGATAGCAAGCGGCCCTCTG GGATCCCTGAGCGATTCTCTGGCTCCAACTCGG GGAACACGGCCACCCTGACCATCAGCAGAGCCC AAGCCGGGGATGAGGCTGACTATTACTGTCAGG TGTGGGACAGCAGTCCTGTGGTATTCGGCGGAG GGACCAAGCTGACCGTCCTAGGT |

TABLE 2C-continued

Coding Sequence for Antibody Variable Light (V_L) Chains

| Contained in Clone | Designation | SEQ ID NO. | Coding Sequence |
|---|---|---|---|
| 63F9 | V_L38 | 446 | GACATCCAGATGACCCAGTCTCCATCCTCCCTGT CTGTATCTGTAGGAGACAGAGTCACCATCACTT GCCGGGCAAGTCAGGACATTAGAAATGATTTAG CCTGGTATCAGCAGACACCAGGGAAAGCCCCTA AGCGCCTGATCTATGCTTCATCCAGTTTGCAAAG TGGGGTCCCATCAAGGTTCAGCGGCACTGGATC TGGGACAGAATTCACTCTCACAATCAGCAGCCT GCAGCCTGAAGATTTTGCAACTTATTTCTGTCTA CAGCGTAATAGTTACCCGCTCACTTTCGGCGGA GGGACCAAGGTGGAGATCAAACGA |
| 67F6v1 | V_L39 | 447 | GATATTGTAATGACCCAGACCCCACTCTCCCTGC CCGTCATCCCTGGAGAGCCGGCCTCCATCTTCTG CAGGTCTAGTCAGAGCCTCTTAAATAGTGATGC TGGTACCACCTATTTGGACTGGTACCTGCAGAA GCCAGGGCAGTCTCCACAACTCCTGATCTATAC GCTTTCCTTTCGGGCCTCTGGAGTCCCAGACAGG TTCAGTGGCAGTGGGTCAGGCACTGATTTCACA CTGAAAATCACTAGGGTGGAGGCTGAGGATGTT GGAGTTTATTATTGCATGCAACGTATAGAGTTCC CTATCACCTTCGGCCAAGGGACACGACTGGAGA TTAAACGA |
| 67F6v2 | V_L108 | 1864 | GATATTGTAATGACCCAGACCCCACTCTCCCTGC CCGTCATCCCTGGAGAGCCGGCCTCCATCTTCTG CAGGTCTAGTCAGAGCCTCTTAAATAGTGATGC TGGTACCACCTATTTGGACTGGTACCTGCAGAA GCCAGGGCGGTCTCCACAACTCCTGATCTATAC GCTTTCCTTTCGGGCCTCTGGAGTCCCAGACAGG TTCAGTGGCAGTGGGTCAGGCACTGATTTCACA CTGAAAATCACTAGGGTGGAGGCTGAGGATGTT GGAGTTTATTATTGCATGCAACGTATAGAGTTCC CTATCACCTTCGGCCAAGGGACACGACTGGAGA TTAAACGA |
| 48C9 49A12 51E2 | V_L78 | 448 | GACATCCAGATGACCCAGTCTCCATCCTCCCTGT CTGCATCTATAGGAGACAGAGTCACCATCACTT GCCGGGCAAGTCAGAACATTAGGACCTATTTAA ATTGGTATCAGCAGAAACCAGGGAAAGCCCCTA AGCTCCTGATTTATGTTGCATCCAGTTTGGAAAG TGGGGTCCCATCAAGGTTCAGTGGCACTGGATC TGGGACAGATTTCGCTCTCACCATCAGCAGTCTC CAACCTGAAGATTTTGCAACTTACTACTGTCAAC AGAGTGACAGTATCCCTCGGACGTTCGGCCAAG GGACCAAGGTGGAAATCAAACGA |
| 48F3 | V_L77 | 449 | GACATCCAGATGACCCAGTCTCCATCCTCCCTGT CTGCATCTGTAGGAGACAGAGTCACCATCACTT GCCGGGCAAGTCAGAGGATTAGCAGTTATTTAA ATTGGTATCAGCAGAAACCAGGGAAAGCCCCTA AGTTCTTGATATATGCTGTATCCAGTTTGCAAAG TGGGGTCCCATCAAGGTTCAGTGGCAGTGGATC TGGGACAGATTTCACTCTCACCATCAGCAGTCTG GAACCTGAAGATTTTGCAACTTACTACTGTCAAC AGAGTTACAGTGCTACATTCACTTTCGGCCCTGG GACCAAAGTGGATATCAAACGA |
| 48F8 53B9 56B4 57E7 57F11 | V_L49 | 450 | GAAATTGTGCTGACTCAGTCTCCAGACTTTCAGT CTGTGACTCCAAAGGAGAAAGTCACCATCACCT GCCGGGCCAGTCAGGACATTGGTAATAGCTTAC ACTGGTACCAGCAGAAACCAGATCAGTCTCCAA AGCTCCTCATCAAGTTTGCTTCCCAGTCCTTCTC AGGGGTCCCCTCGAGGTTCAGTGGCAGTGGATC TGGGACAGATTTCGCCCTCACCATCAATAGCCT GGAAGCTGAAGATGCTGCAACGTATTACTGTCA TCAGAGTAGTGATTTACCGCTCACTTTCGGCGGA GGGACCAAGGTGGACATCAAACGA |
| 48H11 | V_L40 | 451 | GACATCCAGATGACCCAGTCTCCATCCTCTCTGT CTACATCTGTAGGAGACAGAGTCACCATCACTT GCCGGGCAAGTCAGAACATTAGGAGCTATTTAA ATTGGTATCAACTGAAACCAGGGAAAGCCCCTA AGGTCCTGATCTATGGTGCATCTAATTTACAGAG TGGGGTCCCATCAAGGTTCAGTGGCAGTGGATC TGGGACAGATTTCACTCTCACCATCAGCAATCTG |

TABLE 2C-continued

Coding Sequence for Antibody Variable Light (V$_L$) Chains

| Contained in Clone | Designation | SEQ ID NO. | Coding Sequence |
|---|---|---|---|
| | | | CAATCTGAAGATTTTGCAATTTACTACTGTCAAC AGAGTTACAATACCCCGTGCAGTTTTGGCCAGG GGACCAAGCTGGAGATCAAACGA |
| 49A10 48D4 | V$_L$65 | 452 | GATATTGTGATGACCCAGACTCCACTCTCCCTGC CCGTCACCCCTGGAGAGCCGGCCTCCATCTCCTG CAGGTCTAGTCAGAGCCTCTTGGATAGTGATGA TGGAAACACCTATTTGGACTGGTACCTGCAGAA GCCAGGGCAGTCTCCACAGCTCCTGATCTATAC GCTTTCCTATCGGGCCTCTGGAGTCCCAGACAG GTTCAGTGGCAGTGGGTCAGGCACTGATTTCAC ACTGAAAATCAGCAGGGTGGAGGCTGAGGATGT TGGAGTTTATTACTGCATGCAACGTATAGAGTTT CCGATCACCTTCGGCCAAGGGACACGACTGGAG ATTAAACGA |
| 49C8 52H1 | V$_L$45 | 453 | GACATCCAGATGACCCAGTCTCCATCCTCCCTGT CTGCATCTGTAGGAGACAGAGTCACCTTCACTT GCCAGGCGAGTCAGGACATTAACATCTATTTAA ATTGGTATCAGCAGAAACCAGGGAAAGCCCCTA AGCTCCTGATCTACGATGTATCCAATTTGGAAAC AGGGGTCCCATCAAGGTTCAGTGGAAGTGGATC TGGGACAGATTTTACTTTCACCATCAGCAGCCTG CAGCCTGAAGATATTGCAACATATTTCTGTCAAC AATATGATAATCTCCCATTCACTTTCGGCCCTGG GACCAAAGTGGATCTCAAACGA |
| 49G2 50C12 55G11 | V$_L$66 | 454 | GATATTGTGTTGACCCAGACTCCACTCTCCCTGC CCGTCACCCCTGGAGAGCCGGCCTCCATCTCCTG CAGGTCTAGTCAGAGCCTCTTGGATAGTGATGA TGGAGACACCTATTTGGACTGGTACCTGCAGAA GCCAGGGCAGTCTCCACAGCTCCTGATCTATAC GCTTTCCTATCGGGCCTCTGGAGTCCCAGACAG GTTCAGTGGCAGTGGGTCAGGCACTGATTTCAC ACTGAAAATCAGCAGGGTGGAGGCTGAGGATGT TGGAGTTTATTACTGCATGCAACATATAGAATTT CCTTCGACCTTCGGCCAAGGGACACGACTGGAG ATTAAACGA |
| 49G3 | V$_L$47 | 455 | GACATCCAGATGACCCAGTCTCCATCCTCCCTGT CTGCATCTATAGGAGACAGAGTCACCATCACTT GCCAGGCGAGTCAGGGCATTAGCAACTATTTAA ATTGGTATCAGCAGAAACCAGGGAAAGCCCCTA AGCTCCTGATCTACGATGCATCCAATTTGGAAA CAGGGGTCCCATCAAGGTTCAGTGGAAGTGGAT CTGGGACAGATTTTACTTTCACCATCAGCAGCCT GCAGCCTGAAGATATTGCTACATATTACTGTCAC CAGTATGATGATCTCCCGCTCACTTTCGGCGGAG GGACCAAGGTGGAGATCAGACGA |
| 49H12 | V$_L$43 | 456 | GACATCCAGATGACCCAGTCTCCATCCTCCCTGT CTGCATCTGTAGGAGACAGAGTCACCATCACTT GCCAGGCGAGTCAAGACATTACCAAATATTTAA ATTGGTATCAGCAGAAACCAGGGAAAGCCCCTA AGCTCCTGATCTACGATACATTCATTTTGGAAAC AGGGGTCCCATCAAGGTTCAGTGGAAGTGGATC TGGGACAGATTTTACTTTCACCATCAGCAGCCTG CAGCCTGAAGATATTGCAACATATTACTGTCAA CAGTATGACAATTTACCGCTCACCTTCGGCCAA GGGACACGACTGGAGATTAAACGA |
| 51A8 | V$_L$61 | 457 | AATTTTATACTGACTCAGCCCCACTCTGTGTCGG AGTCTCCGGGGAAGACGGTAACCATCTCCTGCA CCCGCAGCAGTGGCAGCATTGCCAGCGACTATG TGCAGTGGTACCAGCAGCGCCCGGGCAGTTCCC CCACCACTGTGATCTATGAGGATAAAGAAAGAT CCTCTGGGGTCCCTGATCGGTTCTCTGGCTCCAT CGACAGTTCCTCCAACTCTGCCTCCCTCACCATC TCTGGACTGAAGACTGAGGACGAGGCTGACTAC TACTGTCAGTCTTATGATCGCAACAATCATGTGG TTTTCGGCGGAGGGACCAAGCTGACCGTCCTAG GT |
| 51C10.1 | V$_L$55 | 458 | TCCTATGAGTTGACACAGCCGCCCTCGGTGTCTG TGTCCCCAGGCCAAACGGCCAGGATCACCTGCT |

TABLE 2C-continued

Coding Sequence for Antibody Variable Light (V_L) Chains

| Contained in Clone | Designation | SEQ ID NO. | Coding Sequence |
|---|---|---|---|
| | | | CTGGAGATGCATTGCCAAAAAAATATGCTTATT<br>GGTACCAGCAGAAGTCAGGCCAGGCCCCTGTGC<br>TGGTCATCTATGAGGACAGCAAACGACCCTCCG<br>GGATCCCTGAGAGATTCTCTGGCTCCATCTCAGG<br>GACAATGGCCACCTTGACTATCAGTGGGGCCCA<br>GGTGGAGGATGAAGCTGACTACTACTGTTACTC<br>AACAGACAGCAGTGTTAATCATGTGGTATTCGG<br>CGGAGGGACCAAGCTGACCGTCCTAGGT |
| 51C10.2 | V_L70 | 459 | TCCTATGACCTGACTCAGCCACCCTCAGTGTCCG<br>TGTCCCCAGGACAGACAGCCAGCATCACCTGCT<br>CTGGAGACGAATTGGGGGATAAATATGCTTGCT<br>GGTATCAGCAGAAGCCAGGCCAGTCCCCTGTGC<br>TGGTCATCTATCAAGATACCAAGCGGCCCTCAG<br>GGATCCCTGAGCGATTCTCTGGCTCCAACTCTGG<br>GAACACAGCCACTCTGACCATCAGCGGGACCCA<br>GGCTATGGATGAGGCTGACTATTACTGTCAGGC<br>GTGGGACAGCGGCACTGTGGTATTCGGCGGAGG<br>GACCAAACTGACCGTCCTAGGT |
| 51E5 | V_L79 | 460 | GACATCCAGATGACCCAGTCTCCATCCTCCCTGT<br>CTGCATCTGTAGGAGACAGAGTCACCATCACTT<br>GCCGGGCAAGTCAGGACATTAGAAATGATTTAG<br>GCTGGTATCAGCAGAAACCAGGGAAAGCCCCTA<br>ACCGCCTGATCTATGCTGCATCCAGTTTGCAATT<br>TGGGGTCCCATCAAGGTTCAGCGGCAGTGGATC<br>TGGGACAGAATTCACTCTCACAATCAGCAGCCT<br>GCAGCCTGAAGATTTTGCAACTTATTACTGTCTA<br>CAACATAGTAGTTACCCGCTCACTTTCGGCGGA<br>GGGACCAGGGTGGAGATCAAACGA |
| 51G2 | V_L51 | 461 | GACATCCAGATGACCCAGTCTCCATCTTCCGTGT<br>CTGCATCTGTAGGAGACAGAGTCACCATCACTT<br>GTCGGGCGAGTCAGGGTATTAGCAGCTGGTTAG<br>CCTGGTATCAGCAGAAACCAGGGAAAGCCCCTA<br>AGCTCCTGATCTATGATGCATCCAGTTTGCAAAG<br>TGGGGTCCCATCAAGGTTCAGCGGCAGTGGATC<br>TGGGACAGATTTCACTCTCACCATCAGCAGCCT<br>GCAGCCTGAAGATTTTGCAACTTACTATTGTCAA<br>CAGACTAACAGTTTCCCTCCGTGGACGTTCGGCC<br>AAGGGACCAAGGTGGAAATCAAACGA |
| 52A8 | V_L41 | 462 | GACATCCAGATGACCCAGTCTCCATCCTTCCTGT<br>CTGCATCTGTAGGAGACAGAGTCACCATCACTT<br>GCCGGGCAAGTCAGACTATTAGCAGTTATTTAA<br>ATTGGCATCAGCAGAAACCAGGGAAAGCCCCTA<br>AGCTCCTGATCTATGCTGCATCCAGTTTGCAAAG<br>TGGGGTCCCATCAAGGTTCAGTGGCAGTGGATC<br>TGGGACAGATTTCAGTCTCACCATCAGCAGTCT<br>GCAACCTGAAGATTTTGCAACTTACTACTGTCAG<br>CAGAGTTACAGTACCCCGCTCACTTTCGGCGGC<br>GGGACCAAGGTGGAGATCAAACGA |
| 52B8 | V_L82 | 463 | GAAGTTGTGCTGACGCAGTCTCCAGCCACCCTG<br>TCTGTGTCTCCAGGGGGAAGAGCCACCCTCTCCT<br>GCAGGGCCAGTCAGAGTGTTAGCGACATCTTAG<br>CCTGGTACCAACAGAAACCTGGCCAGGCTCCCA<br>GGCTCCTCATCTATGGTGCATCCACCAGGGCCA<br>CTGGTATCCCAGCCAGGTTCAGTGGCGGTGGGT<br>CTGGGACAGAGTTCACTCTCACCATCAGTAGCC<br>TGCAGTCTGAAGATTTTGCAGTTTATTTCTGTCA<br>GCAGTATAATAACTGGCCGCTCACTTTCGGCGG<br>AGGGACCAAGGTGGAGATCAAACGA |
| 52C1 | V_L67 | 464 | CAGTCTGTGTTGACGCAGCCGCCCTCAGTGTCTG<br>CGGCCCCAGGACAGAAGGTCACCATCTCCTGCT<br>CTGGAAGCAGCTCCAACATTGGGATTAATTATG<br>TATCCTGGTACCAGCAGCTCCCAGGAACAGCCC<br>CCAAACTCCTCATTTATGACAATAATAAGCGAC<br>CCTCAGGGATTCCTGACCGATTCTCTGGCTCCAA<br>GTCTGGCACGTCAGCCACCCTGGGCATCACCGG<br>ACTCCAGACTGGGGACGAGGCCGATTATTGCTG<br>CGGAACATGGGATAGCAGCCTGAGTGCTGTGGT<br>ATTCGGCGGAGGGACCAAGCTGACCGTCCTAGGT |

TABLE 2C-continued

Coding Sequence for Antibody Variable Light ($V_L$) Chains

| Contained in Clone | Designation | SEQ ID NO. | Coding Sequence |
|---|---|---|---|
| 52F8 | $V_L$42 | 465 | GATATTGTGATGACTCAGTCTCCACTCTCCCTGC<br>CCGTCACCCCTGGAGAGCCGGCCTCCATCTCCTG<br>CAGGTCTAGTCAGAGCCTCCTGCATAGTAATGG<br>ATACAACTATTTGGATTGGTACCTGCAGAAGCC<br>AGGGCAGTCTCCACAGCTCCTGATCTATTTGGGT<br>TCTAATCGGGCCTCCGGGGTCCCTGACAGGTTC<br>AGTGGCAGGGGGTCAGGCACAGATTTTCACTG<br>AAAATCAGCAGAGTGGAGGCTGAGGATGTTGGG<br>ATTTATTACTGCATGCAAGCTCTACAAACTCCAT<br>TCACTTTCGGCCCTGGGACCAATGTGGATATCA<br>AACAA |
| 52H2 | $V_L$84 | 466 | GAAAATGTGTTGACGCAGTCTCCAGGCACCCTG<br>TCTTTGTCTCCAGGGGAAAGAGCCACCCTCTCTT<br>GTAGGGCCAGTCAGAGTGTTAGAAGCAGCTACT<br>TAGCCTGGTACCAGCAGAGACCTGGCCAGGCTC<br>CCAGGCTCCTCATCTTTGGTGCATCCAGGAGGG<br>CCACTGGCATCCCAGACAGGTTCAGTGGCAGTG<br>GGTCTGGGACAGACTTCACTCTCACCATCAGCA<br>GACTGGAGCCTGAAGATTTTGCAGTGTATTACT<br>GTCAGCAGTATGGTAGTTCACCTCGCAGTTTTGG<br>CCAGGGGACCAAGCTGGAGATCAAACGA |
| 53F6 | $V_L$63 | 467 | GATATTGTGATGACTCAGTCTCCACTCTCCCTGC<br>CCGTCACCCCTGGAGAGCCGGCCTCCATCTCCTG<br>CAGGTCTAGTCAGAGCCTCCAGCATAGTAATGG<br>ATACAACTATTTGGATTGGTACCTGCAGAAGCC<br>AGGACAGTCTCCACAGTTATTGATCTATTTGGAT<br>TCTAATCGGGCCTCCGGGGTCCCTGACAGGTTC<br>AGTGGCAGTGGATCAGGCACAGATTTTACACTG<br>AAAATCAGCAGAGTGGAGGCTGAGGATATTGGG<br>GTTTATTACTGCATGCAAGGTCTACAAACTCCTC<br>CCACTTTCGGCGGAGGGACCAAGGTGGAGATCA<br>AACGA |
| 53H5.2 | $V_L$62 | 468 | GACATCCAGATGACCCAGTCTCCATCTTCCCTGT<br>CTGCATCTGTAGGAGACAGAGTCACCATCACTT<br>GCCGGGCAAGTCAGGGCATTAGAAATGATTTAG<br>GCTGGTATCAGCAGAAACCAGGGAAAGCCCCTA<br>AGCGCCTGATCTATGCTGCATCCAGTTTGCAAA<br>GTGGGGTCCCATCAAGGTTCAGCGGCAGCGGAT<br>CTGGGACAGAATTCACTCTCACAATCAGCAGCC<br>TGCAGCCTGAAGATTTTGCAACTTATTACTGTCT<br>ACAGCATAAGAGTTACCCATTCACTTTCGGCCCT<br>GGGACCAAAATGGATATCAAAGGA |
| 53H5.3 | $V_L$80 | 469 | GAAATAGTGATGACGCAGTCTCCAGTCACCTTG<br>TCTGTGTCTCCAGGGGAAAGAGCCATCATCTCCT<br>GCAGGGCCAGTCAGAGTGTTAGCAGCAACGTCG<br>CCTGGTACCAGCAGAAACCTGGCCAGACTCCCA<br>GGCTCCTCATCTATGGTGCATCCACCAGGGCCA<br>CTGGTCTCCCAACCAGGTTTAGTGGCAGTGGGT<br>CTGGGACAGTGTTCACTCTCACCATCAGCAGCCT<br>GCAGCCTGAAGATTTTGCAGTTTATTACTGTCAG<br>CAGTTTAGTAACTCAATCACCTTCGGCCAAGGG<br>ACACGACTGGAGATTAAACGA |
| 54A1<br>55G9 | $V_L$44 | 470 | GACATCCAGATGGCCCAGTCTCCATCCTCCCTGT<br>CTGCATCTGTTGGAGACAGAGTCACCATCACTT<br>GCCAGGCGAGTCAGGACATTAGCATCTATTTAA<br>ATTGGTATCAGCTGAAACCAGGGAAAGCCCCTA<br>AGCTCCTGATCTACGATGTATCCAATTTGGAAAC<br>AGGGGTCCCATCAAGGTTCAGTGGAGGTGGATC<br>TGGGACAGATTTTACTTTCACCATCAGCAGCCTG<br>CAGCCTGAAGATATTGCAACATATTACTGTCAA<br>CAGTATGATAATCTCCCTCTCACTTTCGGCCCTG<br>GGACCAAAGTGGATATCAAACGA |
| 54H10.1<br>55D1<br>48H3<br>53C11 | $V_L$53 | 471 | GAAATTGTGGTGACGCAGTCTCCAGGCACCCTG<br>TCTTTGTCTGTAGGGGAAAGAGCCATCCTCTCCT<br>GCAGGGCCAGTCAGAGTTTTAGCAGCAGTTACT<br>TAGCCTGGTACCAGCAGAAACCTGGCCAGGCTC<br>CCAGGCTCCTCATCTATGGTGCATCCAGCAGGG<br>CCACTGGCATCCCAGACAGGTTCAGCGGCAGTG<br>GGTCTGGGACAGACTTCACTCTCACCATCAGTA |

TABLE 2C-continued

Coding Sequence for Antibody Variable Light (V$_L$) Chains

| Contained in Clone | Designation | SEQ ID NO. | Coding Sequence |
|---|---|---|---|
| | | | GACTGGAGCCTGAAGATTTTGCAGTGTATTACT GTCAGCAGTATGGTAGCTCACGGACGTTCGGCC AAGGGACCAAGGTGGAAATCAAACGA |
| 55D3 | V$_L$71 | 472 | GACATCCAGATGACCCAGTCTCCATCCTCACTGT CTGTATCTGTAGGAGACAGAGTCACCATCACTT GTCGGGCGAGTCAGGACATTAGCAATTATTTAG CCTGGTTTCAGCAGAAACCAGGGAAAGCCCCTA AGTCCCTGATCTATGCTGCATCCAGTTTGCAAAG TGGGGTCCCATCAAGGTTCAGCGGCAGTGGATC TGGGACAGATTTCACTCTCACCATCAGCAGCCT GCAGCCTGAAGATTTTGCAACTTATTACTGCCAA CAGTATAATATTTACCCTCGGACGTTCGGCCAA GGGACCAAGGTGGAAATCAAGCGA |
| 55E4 49B11 50H10 53C1 | V$_L$75 | 473 | GACATCCAGATGACCCAGTCTCCATCCTCCCTGT CTACATCTATAGGAGACAGAATCACCATCACTT GCCGGGCAAGTCAGAGCATTAGTAACTATTTAA ATTGGTTTCAGCAGATCCCAGGGAAAGCCCCTA GGCTCCTGATCTATACAGCTTCCAGTTTGCAAAG TGGGGTCCCATCGAGGTTCAGTGGCAGTGGATC TGGGACAGATTTCACTCTCACCATCAGCAGTCTG CAACCTGAAGATTTTGCAACTTACTACTGTCAAC AGAGTTCCAGTATCCCTTGGACGTTCGGCCAAG GGACCAAGGTGGAAATCAAACGA |
| 55E9 | V$_L$68 | 474 | GATATTGTGATGACTCAGTCTCCACTCTCCCTGC CCGTCACCCCTGGAGAGCCGGCCTCCATCTCCTG CAGGTCTAGTCAGAGCCTCCTGCATAGTAACGG ATTCAACTATTTGGATTGGTACCTGCAGAAGCC AGGGCAGTCTCCACAGGTCCTGATCTATTTGGGT TCTAATCGGGCCTCCGGGGTCCCTGACAGGTTC AGTGGCAGTGGATCAGGCACAGATTTTACACTG AAAATCAGCAGAGTGGAGGCTGAGGATGTTGGG ATTTATTACTGCATGCAAGCTCTACAAACTCTCA TCACCTTCGGCCAAGGGACACGACTGGAGATTA AACGA |
| 55G5 | V$_L$83 | 475 | TCCTATGAACTGACTCAGCCACCCTCAGTGTCCG TGTCCCCAGGACAGACAGCCAGCATCACCTGCT CTGGAGATAATTTGGGGGATAAATATGCTTTCT GGTATCAACAGAAGCCAGGCCAGTCCCCTGTAT TGGTCATCTATCAAGATAACAAGCGGCCCTCAG GGATCCCTGAGCGATTCTCTGGCTCCAACTCTGG GAACACAGCCACTCTGACCATCAGCGGGACCCA GGCTGTGGATGAGGCTGACTATTACTGTCAGGC GTGGGACAGCGCCACTGTGATTTTCGGCGGAGG GACCAAGTTGACCGTCCTAGGT |
| 56A7 56E4 | V$_L$52 | 476 | GACATCCAAATGACCCAGTCTCCATCTTCCGTGT CTGCATCTGTAGGAGACAGAGTCACCATCACTT GTCGGGCGAGTCAGGATATTAGCAGTTGGTTAG CCTGGTATCAGCAGAAACCAGGGAAAGCCCCTA AATTCCTGATCTATGATGCATCCACTTTGCAAAG TGGGGTCCCATCAAGGTTCAGCGGCAGTGGATC TGGGGCAGATTTCACTCTCACCATCAACAACCT GCAGCCTGAAGATTTTGCAACTTACTATTGTCAA CAGACTAACAGTTTTCCTCCGTGGACGTTCGGCC AAGGGACCAAGGTGGAAATCAAACGA |
| 56C11 | V$_L$64 | 477 | TCCTATGTGCTGACTCAGCCACCCTCGGTGTCAG TGGCCCCAGGACAGGCGGCCAGGATTACCTGTG GGGGAAACGACATTGGAAGTAAAAGTGTGCACT GGTACCAGCAGAAGCCAGGCCAGGCCCCTGTGC TGGTCGTCTATGATGATAGCGACCGGCCCTCAG GGATCCCTGAGCGATTCTCTGGCTCCAAGTCTGG GAACACGGCCACCCTGATTATCAGCAGGGTCGA AGCCGGGGAAGAGGCCGACTATTATTGTCAGGT GTGGGATAGTAGTAGTGATGTGGTATTCGGCGG AGGGACCAAGTTGACCGTCCTAGGT |
| 56E7 | V$_L$86 | 478 | GACTCCAGATGACCCAGTCTCCTTCCTCCCTGT CTGCATCTGTAGGAGACAGAGTCACCATCACTT GCCAGGCGAGTCAGGACATTAAAAAATTTTTAA ATTGGTATCAGCAGAAACCAGGTAAAGCCCCTA |

TABLE 2C-continued

Coding Sequence for Antibody Variable Light (V$_L$) Chains

| Contained in Clone | Designation | SEQ ID NO. | Coding Sequence |
|---|---|---|---|
| | | | ACCTCCTGATCTACGATGCATCCAATTTGGAAAC AGGGGTCCCATCAAGGTTCAGTGGAAGTGGATC TGGGACAGATTTTACTTTCACCATCAGCAGCCTG CAGCCTGAAGATATTGCAACATATTACTGTCAA CAATATGCTATTCTCCCATTCACTTTCGGCCCTG GGACCACAGTGGATATCAAACGA |
| 56G1 | V$_L$76 | 479 | GACATCCAGATGACCCAGTCTCCATCCTCCCTGT CTGCATCTGTAGGAGACAGAGTCACCATCACTT GCCGGGCAAGTCAGAGCATTAGCAACTATTTAA ATTGGTTTCTGCAGATACCAGGGAAAGCCCCTA AACTCCTGATCTATGCAGCTTCCAGTTTACAAAG TGGGGTCCCATCGAGGTTCAGTGGCAGTGGATC TGGGACAGATTTCACTCTCACCATCAACAGTCTG CAACCTGAAGATTTTGGAACTTACTACTGCCAA CAGAGTTCCACTATCCCTTGGACGTTCGGCCAA GGGACCAAGGTGGAAATCAAACGA |
| 56G3.3 55B10 | V$_L$81 | 480 | GAAATTGTGTTGACGCAGTCTCCAGGCACCCTG TCTTTGTCTCCAGGGGAAAGAGCCACCCTCTCCT GCAGGGCCAGTCAGAGTGTTAGCAGAGACTACT TAGCCTGGTATCGGCAGAAACCTGGCCAGGCTC CCAGGCTCCTCGTCTATGGTGCATCCGCCAGGG CCACTGGCATCCCAGACAGATTCAGTGGCAGTG GGTCTGGGACAGACTTCACTCTCACCATCAGCA GACTGGAGCCTGAAGATTTTGCAGTGTATTACT GTCAGCAATATGGTAGATCACTATTCACTTTCGG CCCTGGGACCAAAGTGGATATCAAACGA |
| 57B12 | V$_L$72 | 481 | GACATCCAGATGACCCAGTCTCCATCCTCACTGT CTGTATCTGTAGGAGACAGAGTCACCATCACTT GTCGGGCGAGTCATGACATTAGCAATTATTTAG CCTGGTTTCAGCAGAAACCAGGGAAAGCCCCTA AGTCCCTGATCTATGCTGCATCCAGTTTGCAAAG TGGGGTCCCATCAAAGTTCAGCGGCAGTGGATC TGGGACAGATTTCACTCTCACCATCAGCAGCCT GCAGCCTGAAGATTTTGCAACTTATTACTGCCAA CAATATAATACTTACCCTCGGACGTTCGGCCAA GGGACCAAGGTGGAAATCAAGCGA |
| 57D9 | V$_L$87 | 482 | GAAATTGTGTTGACGCAGTCTCCAGGCACCCTG TCTTTGTCTCCAGGGGAAAGAGCCACCCTCTCCT GCAGGGCCAGTCCGAGTGTTAGCAGCAGCTACT TAGCCTGGTACCAGCAGAAACCTGCCCAGGCTC CCAGGCTCCTCATCTATGGTGCATCCAGTAGGG CCACTGGCATCCCAGACAGGTTCAGTGGCAGTG GGTCTGGGACAGACTTCACTCTCACCATCAGCA GACTGGAGCCTGAAGATTTTGCAGTGTATTACT GTCATCAGTATGGTACCTCACCGTGCAGTTTTGG CCAGGGGACCAAGCTGGAGATCAAACGA |
| 59A10 49H4 | V$_L$48 | 483 | GACATCCAGATGACCCAGTCTCCATCTTCCGTGT CTGCATCTGTAGGAGACAGAGTCACCATCACTT GTCGGGCGAGTCAGGGTATTAGCAGCTGGTTAG CCTGGTATCAGCAGAAACAGGGAAAGCCCCTA AACTCCTGATCTATGGTGCATCCAGTTTGCAAAG TGGGGTCCCATCAAGGTTCAGCGGCAGTGGATC TGGGACAGATTTCACTCTCACCATCAGCAGCCT GCAGCCTGAAGATTTTGCAACTTATTATTGTCAA CAGACTAACAGTTTCCCTCCGTGGACGTTCGGCC AAGGGACCAAGGTGGAAATCAAACGA |
| 59C9 58A5 57A4 57F9 | V$_L$50 | 484 | GACATCCAGATGACCCAGTCTCCATCTTCCGTGT CTGCATCTGTAGGAGACAGAGTCACCATCACTT GTCGGGCGAGTCAGGATATTGACAGCTGGTTAG TCTGGTATCAGCAGAAACAGGGAAAGCCCCTA ACCTCCTGATCTATGCTGCATCCAATTTGCAAAG AGGGGTCCCATCAAGGTTCAGCGGCAGTGGATC TGGGACAGATTTCACTCTCACCATCGCCAGCCTG CAGCCTGAAGATTTTGCAACTTACTATTGTCAGC AGACTAACAGTTTCCCTCCGTGGACGTTCGGCC AAGGGACCAAGGTGGAAATCAAACGA |
| 59G10.2 | V$_L$60 | 485 | TCCTATGAGCTGTCTCAGCCACCCTCAGTGTCCG TGTCCCCAGGACAGACAGTCAGCATCACCTGCT |

TABLE 2C-continued

Coding Sequence for Antibody Variable Light (V$_L$) Chains

| Contained in Clone | Designation | SEQ ID NO. | Coding Sequence |
|---|---|---|---|
| | | | CTGGAGATAATTTGGGGGATAAATATGCTTGCT GGTATCAGCAGAGGCCAGGCCAGTCCCCTGTCC TGGTCATCTATCAAGATACCAAGCGGCCCTCAG GGATCCCTGAGCGATTCTCTGGCTCCAATTCTGG GAACACAGCCACTCTGACCATCAGCGGGACCCA GGCTATGGATGAGGCTGACTATTACTGTCAGGC GTGGGACAGCAGCACTACATGGGTGTTCGGCGG AGGGACCAAGCTGACCGTCCTAGGT |
| 59G10.3 | V$_L$54 | 486 | CAGTCTGTGTTGACGCAGCCGCCCTCAGTGTCTG CGGCCCCAGGACAGAAGGTCACCATCTCCTGCT CTGGAAGCAGCTCCAACATTGGGGATAATTATG TATCCTGGTACCAGCAGTTCCCAGGAACAGCCC CCAAACTCCTCATTTATGACAATAATAAGCGAC CCTCAGGGATTCCTGACCGATTCTCTGGCTCCAA GTCTGGCACGTCAGCCACCCTGGGCATCACCGG ACTCCAGACTGGGGACGAGGCCGATTATTACTG CGGAACATGGGACAGCAGCCTGAGTGTTATGGT TTTCGGCGGAGGGACCAAGCTGACCGTCCTAGGT |
| 60D7 | V$_L$69 | 487 | GATATTGTGCTGACCCAGACTCCACTCTCCCTGC CCGTCACCCCTGGAGAGCCGGCCTCCATCTCCTG CAGGTCTAGTCAGAGCCTCTTGGATAGTGATGA TGGAGACACCTATTTGGACTGGTACCTGCAGAA GCCAGGGCAGTCTCCACAGCTCCTGATCTATAC GCTTTCCTATCGGGCCTCTGGAGTCCCAGACAG GTTCAGTGGCAGTGGGTCAGGCACTGATTTCAC ACTGAAAATCAGCAGGGTGGAGGCTGAGGATGT TGGAGTTTATTACTGCATGCAACGTATAGAGTTT CCGCTCACTTTCGGCGGAGGGACCAAGGTGGAG ATCAAACGA |
| 60F9 48B4 52D6 | V$_L$58 | 488 | GAAATTATGTTGACGCAGTCTCCAGGCACCCTG TCTTTGTCTCCAGGGGAAAGGGCCACCCTCTCCT GCAGGGCCAGTCAGAGGGTTCCCAGCAGCTACA TAGTCTGGTACCAGCAGAAACCTGGCCAGGCTC CCAGGCTCCTCATCTATGGTTCATCCAACAGGGC CACTGGCATCCCAGACAGGTTCAGTGGCAGTGG GTCTGGGACAGACTTCACTCTCACCATCGGCAG ACTGGAGCCTGAAGATTTTGCAGTGTACTACTGT CAGCAGTATGGTAGCTCACCTCCGTGGACGTTC GGCCAAGGGACCAAGGTGGCAATCAAACGA |
| 60G5.2 | V$_L$46 | 489 | TCCTATGAGCTGACTCAGCCACCCTCAGTGTCCG TGTCCCCAGGACAGACAGCCAGCATCACCTGCT CTGGAAATAAAATTGGGGATAAATATGTTTGCT GGTATCAGCAGAAGCCAGGCCAGTCCCCTGTCT TGGTCATCTATCAAGATAGCAAGCGGCCCTCAG GGATCCCTGAGCGATTCTCTGGCTCCAACTCTGG GAACACAGCCACTCTGACCATCAGCGGGACCCA GGCTTTGGATGAGGCTGACTATTACTGTCAGGC GTGGGACAGCAGCACTTGGGTGTTCGGCGGAGG GACCAAGCTGACCGTCCTAGGT |
| 61G5 | V$_L$59 | 490 | GAAATTATGTTGACGCAGTCTCCAGGCACCCTG TCTTTGTCTCCAGGGGAAAGAGCCACCCTCTCCT GCAGGGCCAGTCAGAGAGTTCCCAGCAGCTACT TAGTCTGGTACCAGCAGAAACCTGGCCAGGCTC CCAGGCTCCTCATCTATGGTGCATCCAACAGGG CCACAGGCATCCCAGACAGGTTCAGCGGCAGTG GGTCTGGGACAGACTTCACTCTCACCATCGGCA GACTGGAGCCTGAAGATTTTGCAGTGTATTACT GTCAGCAGTATGGTAGTTCACCTCCGTGGACGTT CGGCCAAGGGACCAAGGTGGCAATCAAACGA |
| 52C5 | V$_L$73 | 491 | GACATCCAGATGACCCAGTCTCCATCCTCCCTGT CTGCATCTATAGGAGACAGAGTCACCATCACTT GCCGGGCAAGTCAGAGCATTAGCAACTATTTAA ATTGGTTTCAGCAGATCCCAGGGAAAGCCCCTA GGCTCCTGATCTATGCAGCTTCCAGTTTGCAAAG TGGGGTCCCATCGAGGTTCAGTGGCAGTGGATC TGGGACAGATTTCACTCTCACCATCAGCAGTCTG CAACCTGAAGATTTTGCAATTTACTACTGTCAAC AGAGTTCCAGTATCCCTTGGACGTTCGGCCAAG GGACCAAGGTGGAAATCAAACGA |

TABLE 2C-continued

Coding Sequence for Antibody Variable Light (V_L) Chains

| Contained in Clone | Designation | SEQ ID NO. | Coding Sequence |
|---|---|---|---|
| 61H5 52B9 | V_L88 | 492 | GAAATTGTGTTGACGCAGTCTCCAGGCACCCTG TCTTTGTCTCCAGGGGAAAGAGCCACCCTCTCCT GCAGGGCCAGTCAGAGTGTTAGCAGAGACTACT TAGCCTGGTACCGGCAGAAACCTGGCCAGGCTC CCAGGCTCCTCATCTATGGTGCATCCAGCAGGG CCACTGGCATCCCAGACAGATTCAGTGGCAGTG GGTCTGGGACAGACTTCACTCTCACCATCAGCA GACTGGAGCCTGAAGATTTTGCAGTGTATTACT GTCAGCAATATGGTAGATCACTATTCACTTTCGG CCCTGGGACCACAGTGGATATCAAACGA |
| 59D10v1 | V_L56 | 493 | TCCTATGAGCTGACACAGCCACCCTCGGTGTCTG TGTCCCCAGGCCAAACGGCCAGGATCACCTGCT CTGGAGATGCAGTGCCAAAAAAATATGCTAATT GGTACCAGCAGAAGTCAGGCCAGGCCCCTGTGC TGGTCATCTATGAGGACAGCAAACGACCCTCCG GGATCCCTGAGAGATTCTCTGGCTCCAGCTCAG GGACAATGGCCACCTTGACTATCAGTGGGGCCC AGGTGGAGGATGAAGCTGACTACTACTGTTACT CAACAGACAGCAGTGGTAATCATGTGGTATTCG GCGGAGGGACCAAGCTGACCGTCCTAGGT |
| 59D10v2 | V_L57 | 494 | TCCTATGAGTTGACTCAGCCACCCTCAGTGTCCG TGTCCCCAGGACAGACAGCCAGCATCACCTGCT CTGGAGATAAAATTGGGGATAAATACGTTTGCT GGTATCAGCAGATGCCAGGCCAGTCCCCTGTGT TGGTCATCCATCAAAATAACAAGCGGCCCTCAG GGATCCCTGAGCGATTCTCTGGCTCCAACTCTGG GAACACAGCCACTCTGACCATCAGCGGGACCCA GGCTATGGATGAGGCTGACTATTATTGTCAGGC GTGGGATAGTAGTACTGCGGTATTCGGCGGAGG GACCAAGCTGACCGTCCTAGGT |
| 56G3.2 | V_L85 | 495 | GAAACAGTGATGACGCAGTCTCCAGCCACCCTG TCTGTGTCTCCAGGGGAAAGAGCCACCCTCTCCT GCAGGGCCAGGCAGAGTGTTGGCAGTAACTTAA TCTGGTACCAGCAGAAACCTGGCCAGGCTCCCA GGCTCCTCATCTTTGGTGCATCCAGCAGGGACA CTGGTATCCCAGCCAGGTTCAGTGGCAGTGGGT CTGGGACAGAGTTCACTCTCACCATCAGCAGCC TGCAGTCTGAAGATTTTGCAGTTTATTACTGTCA GCAGTATAATAATTGGCCTCTCACTTTCGGCGGA GGGACCAAGGTGGAGATCAAACGA |
| 66F7 | V_L7 | 496 | GACATCCAGATGACCCAGTCTCCATCCTCCCTGT CTGCATCTGTAGGAGACAGAGTCACCATCACTT GCCGGACAAGTCAGAGCATTAGCAACTATTTAA ATTGGTATCAGCAGAAACCAGGAAAAGCCCCTA ACCTCCTGATCTATGCTGCATCCAGTTTGCAAAG TGGGGTCCCATCAAGATTCAGTGGCAGTGGATC TGGGACAGATTTCACTCTCACCATCAGCGGTCTG CAACCTGAGGATTTTTCAACTTACTACTGTCAAC AGAGTTACAGTACCTGCTCACTTTCGGCGGAG GGACCAAGGTGGAGATCAAACGA |
| 48G4 53C3.1 | V_L89 | 497 | GAAATTGTGTTGACGCAGTCTCCAGGCACCCTG TCTTTGTCTCCAGGGGAAAGAGCCACCCTCTCCT GCAGGGCCAGTCAGAGTGTTGCCAGCAGTTACT TAGTCTGGTACCAACAGAAACCTGGCCAGGCTC CCAGGCTCCTCATCTATGGTGCATTCAGCAGGG CCACTGGCATCCCAGACAGGTTCAGTGGCAGTG GGTCTGGGACAGACTTCACTCTCACCATCAGGA GACTGGAGCCTGAAGATTTTGCAGTGTATTACT GTCAGCAGTATGGTACCTCACCATTTACTTTCGG CCCTGGGACCAAAGTGGATCTCAAACGA |
| 50G1 | V_L90 | 498 | GACATTGTGATGACCCAGACTCCACTCTCCCTGC CCGTCAGCCCTGGAGAGCCGGCCTCCATCTCCT GCAGGTCTAGTCAGAGCCTCTTGGATAGTGATG ATGGAGACACCTATTTGGACTGGTACCTGCAGA AGCCAGGGCAGTCTCCACAGCTCCTGATCTATA CGCTTTCCTATCGGGCCTCTGGAGTCCCAGACAG GTTCAGTGTCAGTGGGTCAGGCACTGATTTCAC ACTGAAAATCAGCAGGGTGGAGGCTGAGGATGT TGGAGTTTATTACTGCATGCAACGTATAGAGTTT |

TABLE 2C-continued

Coding Sequence for Antibody Variable Light (V$_L$) Chains

| Contained in Clone | Designation | SEQ ID NO. | Coding Sequence |
|---|---|---|---|
| | | | CCGCTCACTTTCGGCGGAGGGACCAAGGTGGAG ATCAAACGA |
| 58C2 | V$_L$91 | 499 | GAAATTGTGATGACCCAGACTCCACTCTCCCTGC CCGTCACCCCTGGAGAGCCGGCCTCCATCTCCTG CAGGTCTAGTCAGAGCCTCTTCGATAATGATGA TGGAGACACCTATTTGGACTGGTACCTGCAGAA GCCAGGGCAGTCTCCACAACTCCTGATCTATAC GCTTTCCTATCGGGCCTCTGGAGTCCCAGACAG GTTCAGTGGCAGTGGGTCAGGCACTGATTTCAC ACTGAAAATCAGCAGGGTGGAGGCTGAGGATGT TGGAGTTTATTACTGCATGCAACGTTTAGAGTTT CCGATCACCTTCGGGCAAGGGACACGACTGGAG ATTAAACGA |
| 60G5.1 | V$_L$74 | 1865 | GACATCCAGATGACCCAGTCTCCATCCTCCCTGT CTGCATCTATAGGAGACAGAGTCACCATCACTT GCCGGGCAAGTCAGAGCATTAGCAACTATTTAA ATTGGTTTCAGCAGATCCCAGGGAAAGCCCCTA GGCTCCTGATCTATGCAGCTTCCAGTTTGCAAAG TGGGGTCCCATCGAGGTTCAGTGGCAGTGGATC TGGGACAGATTTCACTCTCACCATCAGCAGTCTG CAACCTGAAGATTTTGCAACTTACTACTGTCAAC AGAGTTCCAGTATCCCTTGGACGTTCGGCCAAG GGACCAAGGTGGAAATCAAACGA |
| 50D4 | V$_L$92 | 500 | GACATCCAGATGACCCAGTCTCCATCCTCCCTGT CTGCATCTGTAGGAGACAGAGTCACCATCACTT GCCGGGCGAGTCAGGACATTAGCAATTATTTAG CCTGGTATCAGCAGAAACCAGGGAAAGTTCCTA CGCTCCTGATCTATGCTGCATCCACTTTGCTATC AGGGGTCCCATCTCGGTTCAGTGGCAGTGGATC TGGGACAGATTTCACTCTCACCATCAGCAGCCT GCAGCCTGAAGATGTTGCAGCTTATTACTGTCA AAAGTATTACAGTGCCCCTTTCACTTTCGGCCCT GGGACCAAAGTGGATATCAACCGA |
| 50G5v1 | V$_L$93 | 501 | GACATCCAGATGACCCAGTCTCCATCCTCCCTGT CTGCATCTGTAGGAGACAGAGTCACTATCACTT GCCGGGCAAGTCAGGGCATTAGAAATGATTTAG GCTGGTATCAGCAGAAACCAGGGAAAGCCCCTA ACCGCCTGATCTATGCTGCGTCCAGTTTGCAAAG TGGGGTCCCATCAAGGTTCAGCGGCAGTGGATC TGGGACAGAATTCACTCTCACAATCAGCAGCCT GCAGCCTGAAGATTTTGCAACTTATTACTGTCTA CAGCATAATAGTTACCCTCGGACGTTCGGCCAA GGGACCAAGGTGGAAATCAAACGA |
| 50G5v2 | V$_L$94 | 502 | GATGTTGTGATGACTCAGTGTCCACTCTCCCTGC CCGTCACCCTTGGACAGCCGGCCTCCATCTCCTG CAGGTCTAGTCAAAGACTCGTATACAGTGATGG AAACACCTACTTGAATTGGGTTCAGCAGAGGCC AGGCCAATCTCCAAGGCGCCTAATTTATAAGGT TTCTAACTGGGACTCTGGGGTCCCAGACAGATT CAGCGGCAGTGGGTCAGGCACTGATTTCACACT GAAAATCAGCAGGGTGGAGGCTGAGGATGTTGG GGTTAATTACTGCATGGAAGGTACACACTGGCC TCGGGACTTCGGCCAAGGGACACGACTGGAGAT TAAACGA |
| 51C1 | V$_L$95 | 503 | GACATCCAGATGACCCAGTCTCCATCCTCCCTGT CTGCATCTATAGGAGACAGAGTCACCATCACTT GCCGGGCAAGTCAGAGCATTAGCAACTATTTAA ATTGGTTTCAGCAGATCCCAGGGAAAGCCCCTA GACTCCTGATCTATGCAGCTTCCAGTTTGCAAAG TGGGGTCCCATCGAGGTTTAGTGGCAGTGGATC TGGGACAGATTTCACTCTCACCATCAGCAGTCTG CAACCTGAAGATTTTGCAACTTACTACTGTCAAC AGAGTTCCAGTATCCCTTGGACGTTCGGCCAAG GGACCACGGTGGAAATCAAACGA |
| 53C3.2 | V$_L$96 | 504 | GACATAGTGATGACGCAGTCTCCAGCCACCCTG TCTGTGTCTCCAGGGGAAAGAGCCACCCTCTCCT GCAGGGCCAGTCAGAGTATTAGCAGCAATTTAG CCTGGTACCAGCAGACACCTGGCCAGGCTCCCA |

TABLE 2C-continued

Coding Sequence for Antibody Variable Light (V_L) Chains

| Contained in Clone | Designation | SEQ ID NO. | Coding Sequence |
|---|---|---|---|
| | | | GGCTCCTCATCTATGGTACATCCATCAGGGCCA GTACTATCCCAGCCAGGTTCAGTGGCAGTGGGT CTGGGACAGAGTTCACTCTCACCATCAGCAGCC TGCAGTCTGAAGATTTTGCAATTTATTACTGTCA CCAGTATACTAACTGGCCTCGGACGTTCGGCCA AGGGACCAAGGTGGAAATCAAACGA |
| 54H10.3 | V_L97 | 505 | GACATCCAGATGACCCAGTCTCCATCCTCCCTGT CTGCATCTGTAGGAGACAGAGTCACCATCACTT GCCGGGCAAGTCAGACCATTAGCATCTATTTAA ATTGGTATCAGCAAAAACCAGGGAAAGCCCCTA AGTTCCTGATCTATTCTGCATCCAGTTTGCAAAG TGGGGTCCCATCAAGGTTCAGTGGCAGTGGATC TGGGACAGATTTCACTCTCACCATCAGCAGTCTG CAACCTGAAGATTTTTCAACTTACTTCTGTCAAC AGAGTTACAGTTCCCCGCTCACTTTCGGCGGAG GGACCAAGGTGGAGATCAAACGA |
| 55A7 | V_L98 | 506 | GACATCCAGATGACCCAGTCTCCATCCTCCCTGT CTGCATCTGTAGGAGACAGAGTCACCATCACTT GCCGGGCAAGTCAGAGCATTAGCAGCTATTTAA ATTGGTATCAGCAGAAACCAGGGAAAGCCCCTA AGCTCCTGATCTATGCTGCATCCAGTTTGCAAAG TGGGGTCCCATCAAGGTTCAGTGGCAGTGGATC TGGGACAGATTTCACTCTCACCATCAGCAGTCTG CAACCTGAAGATTTTGCAACTTACTACTGTCAAC AGACTTACAGTGCCCCATTCACTTTCGGCCCTGG GACCAAAGTGGATATCAAACGA |
| 55E6 | V_L99 | 507 | GAAATTGTGTTGACGCAGTCTCCAGGCACCCTG TCTTTGTCTCCAGGGGAAAGAGCCACCCTCTCCT GCAGGGCCAGTCAGAGTGTTAGTCGCAGCCACT TAGCCTGGTACCAGCAGAACTCTGGCCAGGCTC CCAGGCTCCTCATCTATGGTGCATCCAGCAGGG CCACTGGCATCCCAGACAGGTTCAGTGGCAGTG GGTCTGGGACAGACTTCACTCTCACCATCAGCA GACTGGAGCCTGAAGATTTTGCAGTGTATTACT GTCAGCAGTATGGTAGTTCACCGTGGACGTTCG GCCAAGGGACCAAGGTGGAAATCAAACGA |
| 61E1 | V_L100 | 508 | GACATCCAGATGACCCAGTCTCCATCCTCCCTGT CTGCATCTATTAGAGACCGAGTCACCATCACTTG CCGGGCAAGTCAGAGCATTGGCACCTTTTTAAA TTGGTATCAGCAGAAACCAGGGACAGCCCCTAA GCTCCTGATCTATGCTGCGTCCAGTTTGCAAAGT GGGGTCCCATCAAGGTTCAGTGGCAGTGGATCT GGGACAGATTTCACTCTCACCATCAGCAGTCTA CATCCTGAAGATTTTGCGTCTTACTATTGTCAAC AGAGTTTCAGTACCCCGCTCACTTTCGGCGGAG GGACCAAGGTGGAGATCACACGA |

TABLE 2D

Coding Sequence for Antibody Variable Heavy (V_H) Chains

| Contained in Clone | Designation | SEQ ID NO. | Coding Sequence |
|---|---|---|---|
| 63E6 66F7 | V_H6 | 509 | CAGGTGCAGCTTATGCAGTCGGGGCTGAGGTG AAGAAGCCTGGGGCCTCAGTGAAGGTCTCCTGC AAGGCTTCTGGATACACCTTCACCGGCTACTATA TGCACTGGGTGCGACAGGCCCCTGGACAAGGGC TTGAGTGGATGGGATGGATGAACCCTAATAGTG GTGCCACAAAGTATGCACAGAAGTTTCAGGGCA GGGTCACCATGACCAGGGACACGTCCATCAGCA CAGCCTACATGGAGCTGAGCAGGCTGAGATCTG ACGACACGGCCGTGTATTACTGTGCGAGAGAAC TCGGTGACTACCCCTTTTTTGACTACTGGGGCCA GGGAACCCTGGGCATCGTCTCCTCA |
| 66D4 | V_H17 | 510 | CAGGTGCAACTGGTGCAGTCTGGGGCTGAGGTG AAGAAGCCTGGGGCCTCAGTGAAGGTC |

TABLE 2D-continued

Coding Sequence for Antibody Variable Heavy ($V_H$) Chains

| Contained in Clone | Designation | SEQ ID NO. | Coding Sequence |
|---|---|---|---|
| | | | TCCTGCAGGGCTTCTGGGTACACCTTCACCGGCT<br>ACTATATACACTGGATGCGACAGGCC<br>CCTGGCCATGGGCTGGAGTGGATGGGATGGATC<br>AACCCTCCCAGTGGTGCCACAAACTAT<br>GCACAGAAGTTTCGGGGCAGGGTCGCCGTGACC<br>AGGGACACGTCCATCAGCACAGTCTAC<br>ATGGAACTGAGCAGGCTGAGATCTGACGACACG<br>GCCGTATATTACTGTGCGAGAGAGACT<br>GGAACTTGGAACTTCTTTGACTACTGGGGCCAG<br>GGAACCCTGGTCACCGTCTCCTCA |
| 66B4 | $V_H$10 | 511 | CAGGTGCAGCTGGTGCAGTCTGGGGCTGAGGTG<br>AAGAAGCCTGGGGCCTCAGTGAAGGTCTCCTGC<br>AAGGCATCTGGATACACCTTCACCGGCTACTATT<br>TGCACTGGGTGCGACAGGCCCCTGGACAAGGGC<br>TTGAGTGGATGGGATGGATCAACCCTAACAGTG<br>GTGGCACAGACTATGCACAGAAGTTTCAGGGCC<br>GGGTCACCATGACCAGGGACACGTCCATCAGTA<br>CAGCCTACATGGAGCTGAGCAGGCTGAGATCTG<br>ACGACACGGCCGTGTATTACTGTGTGGGAGACG<br>CAGCAACTGGTCGCTACTACTTTGACAACTGGG<br>GCCAGGGAACCCTGGTCACCGTCTCCTCA |
| 65B1 | $V_H$18 | 512 | CAGGTGCAGCTGGTGCAGTCTGGGGCTGAGGTG<br>AAGAGGCCTGGGGCCTCAGTGAAGGTCTCCTGC<br>AAGGCTTCTGGATACACCTTCACCGGCTACTTTA<br>TGCACTGGGTGCGACAGGCCCCTGGACAAGGGC<br>TTGAGTGGATGGGATGGATCAACCCTAACAGTG<br>GTGCCACAAACTATGCACAGAAGTTTCACGGCA<br>GGGTCACCATGACCAGGGACACGTCCATCACCA<br>CAGTCTACATGGAGCTGAGCAGGCTGAGATCTG<br>ACGACACGGCCGTGTATTACTGTACGAGAGAAC<br>TGGGGATCTTCAACTGGTTCGACCCCTGGGGCC<br>AGGGAACCCTGGTCACCGTCTCCTCA |
| 65B4 | $V_H$20 | 513 | GAGGTGCAGCTGGTGGAGTCTGGGGGAGGCTTG<br>GTACAGCCTGGGGGGTCCCTGAGACTCTCCTGT<br>GCAGCCTCTGGATTCGCCTTCAGTAGTTACGACA<br>TGCACTGGGTCCGCCAAGCTACAGGAAAAGGTC<br>TGGAGTGGGTCTCAACTATTGATACTGCTGGTG<br>ACGCTTACTATCCAGGCTCCGTGAAGGGCCGAT<br>TCACCATCTCCAGAGAAAATGCCAAGACCTCCT<br>TGTATCTTCAAATGAACAGCCTGAGAGCCGGGG<br>ACACGGCTGTGTATTACTGTACAAGAGATCGGA<br>GCAGTGGCCGGTTCGGGGACTTCTACGGTATGG<br>ACGTCTGGGGCCAAGGGACCGCGGTCACCGTCT<br>CCTCA |
| 67A4 | $V_H$19 | 514 | GAGGTGCAGCTGGAGGAGTCTGGGGGAGGCTTG<br>GTACAGCCTGGGGGGTCCCTGAGACTCTCCTGT<br>GCAGCCTCTGGATTCACCTTCAGGACCTACGAC<br>ATGCACTGGGTCCGCCAAGTTACAGGAAAAGGT<br>CTGGAGTGGGTCTCAGCTATTGGTATTGCTGGTG<br>ACACATACTATTCAGACTCCGTGAAGGGCCGAT<br>TCACCATCTCCAGAGAAAATGCCAAGAACTCCC<br>TGTATCTTCAAATGAACAGTCTAAGAGTCGGGG<br>ACACGGCTGTGTATTACTGTGCAAGAGATCGGA<br>GCAGTGGCCGGTTCGGGGACTACTACGGTATGG<br>ACGTCTGGGGCCAAGGGACCACGGTCACCGTCT<br>CCTCA |
| 63A10v1<br>63A10v2<br>63A10v3 | $V_H$21 | 515 | GAGGTGCAGCTGGTGGAGTCTGGGGGAGACTTG<br>GTAAAGCCTGGGGGGTCCCTTAGACTCTCCTGT<br>GCAGTCTCTGGAATCACTTTCAGTAACGCCTGG<br>ATGAGCTGGGTCCGCCAGGCTCCAGGGAAGGGG<br>CTGGAGTGGGTTGGCCGTATTAAAAGCAAAACT<br>GATGGTGGGACAACAGACTACGCTGCACCCGTG<br>AAAGGCAGATTCACCGTCTCAAGAGATGGTTCA<br>AAAAATACGCTGTATCTGCAAATGAACAGCCTG<br>AAAACCGAGGACACAGCCGTGTATTACTGTACC<br>ACAGATAGTAGTGGGAGCTACTACGTGGAGGAC<br>TACTTTGACTACTGGGGCCAGGGAACCCTGGTC<br>ACCGTCTCCTCA |

TABLE 2D-continued

Coding Sequence for Antibody Variable Heavy (V_H) Chains

| Contained in Clone | Designation | SEQ ID NO. | Coding Sequence |
|---|---|---|---|
| 65H11v1<br>65H11v2 | $V_H22$ | 516 | GAGGTGCAACTGGTGGAGTCTGGGGGAGGCTTG<br>GTAAAGCCTGGGGGGTCCCTTAGACTCTCCTGT<br>GCAGCCTCTGGATTCACTTTCAGTAACGCCTGGA<br>TGAGCTGGGTCCGCCAGGCTCCAGGGAAGGGGC<br>TGGAGTGGGTTGGCCGTATTATAGGCAAAACTG<br>ATGGTGGGACAACAGACTACGCTGCACCCGTGA<br>AAGGCAGATTCACCATTTCAAGAGATGATTCAA<br>AAAACACGCTGTATCTGCAAATGAACAGCCTGA<br>AAACCGAGGACACAGCCGTGTATTACTGTACCT<br>CAGATAGTAGTGGGAGCTACTACGTGGAGGACT<br>ACTTTGACTACTGGGGCCAGGGAACCCTGGTCG<br>CCGTCTCCTCA |
| 67G10v1<br>67G10v2 | $V_H9$ | 517 | GAGGTGCAACTGGTGGAGTCTGGGGGAGGCTTG<br>GTAAAGCCGGGGGGGTCCCTTAGACTCGCCTGT<br>GCAGCCTCTGGAATCACTTTCAATAACGCCTGG<br>ATGAGTTGGGTCCGCCAGGCTCCAGGGAAGGGG<br>CTGGAATGGGTTGGCCGTATTAAAAGCAAAACT<br>GATGGTGGGACAACAGACTACGCTGCACCCGTG<br>AAAGGCAGATTCACCATCTCAAGAGATGATTCA<br>AAAAGTATACTGTATCTGCAAATGAACAGCCTG<br>AAATCCGAGGACACAGCCGTGTATTATTGTACC<br>ACAGATAGTAGTGGGAGCTACTACGTGGAGGAC<br>TACTTTGACTACTGGGGCCAGGGAACCCTG<br>GTCACCGTCTCCTCA |
| 64C8 | $V_H23$ | 518 | CAGGTGCAGCTGGTGGAGTCTGGGGGAGGCGTG<br>GTCCAGCCTGGGAGGTCCCTGAGACTCTCCTGT<br>GTAGCCTCTGGATTCACCTTCAGTAGCTATGGCA<br>TGCACTGGGTCCGCCAGGATCCAGGCAAGGGGC<br>TGGAGTGGGTGGCAGTTATATCATATGATGGAA<br>GTAACAAACACTATGCAGACTCCGTGAAGGGCC<br>GATTCACCATCTCCAGAGACAATTCCAAGAACA<br>CGCTGTATCTGCAAATGAACAGCCTGAGAGCTG<br>AGGACACGGCTGTGTATTACTGTGCGAGGGAAT<br>TACTATGGTTCGGGGAGTATGGGGTAGACCACG<br>GTATGGACGTCTGGGGCCAAGGGACCACGGTCA<br>CCGTCTCCTCA |
| 63G8v1<br>63G8v2<br>63G8v3<br>68D3v1<br>64A8<br>67B4 | $V_H1$ | 519 | CAGGCGCAGCTGGTGGAGTCTGGGGGAGGCGTG<br>GTCCAGCCTGGGAGGTCCCTGAGACTCTCCTGT<br>GCAGCCTCTGGATTCACCTTCAGTAGCTATGGCA<br>TACACTGGGTCCGCCAGGCTCCAGGCAAGGGGC<br>TGGAGTGGGTGGCAGTTATATCATATGATGGAA<br>GTAATAAATACTATGCAGACTCCGTGAAGGGCC<br>GATTCACCATCTCCAGAGACAATTCCAAGAACA<br>CGCTGTATCTGCAAATGAACAGCCTGAGAGCTG<br>AGGACACGGCTGTGTATTACTGTGCGACTACGG<br>TGACTAAGGAGGACTACTACTACGGTATGG<br>ACGTCTGGGGCCAAGGGACCACGGTCACCGTCT<br>CCTCA |
| 68D3v2 | $V_H95$ | 1866 | CAGGCGCAGCTGGTGGAGTCTGGGGGAGGCGTG<br>GTCCAGCCTGGGAGGTCCCTGAGACTC<br>TCCTGTGCAGCCTCTGGATTCACCTTCAGTAGCT<br>ATGGCATGCACTGGGTCCGCCAGGCT<br>CCAGGCAAGGGGCTGGAGTGGGTGGCATTTATA<br>TCATATGCTGGAAGTAATAAATACTAT<br>GCAGACTCCGTGAAGGGCCGATTCACCATCTCC<br>AGAGACAATTCCAAGAACACGCTGTAT<br>CTGCAAATGAGCAGCCTGAGAGCTGAGGACACG<br>GCTGTGTATTACTGTGCGACTACGGTG<br>ACTGAGGAGGACTACTACTACGGTATGGAC<br>GTCTGGGGCCAAGGGACCACGGTCACC<br>GTCTCCTCA |
| 66G2 | $V_H11$ | 520 | CAGGTGCAGCTGGTGGAGTCTGGGGGAGGCGTG<br>GTCCAGCCTGGGAGGTCCCTGAGACTCTCCTGT<br>GCAGCCTCAGGATTCACCTTCAGTAGCTATGGC<br>ATGCACTGGGTCCGCCAGGCTCCAGGCAAGGGG<br>CTGGAGTGGGTGGCAGGTATATCATATGATGGA<br>AGTAATAAAAACTATGCAGACTCCGTGAAGGGC<br>CGAATCACCATCTCCAGAGACAATCCCAAGAAC<br>ACGCTGTATCTGCAAATGAACAGCCTGAGAGCT<br>GAGGACACGGCTGTGTATTACTGTGCGACTACG |

TABLE 2D-continued

Coding Sequence for Antibody Variable Heavy (V_H) Chains

| Contained in Clone | Designation | SEQ ID NO. | Coding Sequence |
|---|---|---|---|
| | | | GTGACTAAGGAGGACTACTACTACTACGGTATG GACGTCTGGGGCCAAGGGACCACGGTCACCGTC TCCTCA |
| 65D1 | V_H26 | 521 | CAGGTGCAACTGGTGGAGTCTGGGGGAGGCGTG GTCCAGCCTGGGAGGTCCCTGAGACTCTCCTGT GCAGCGTCTGGATTCACCTTCAGTTACTATTACA TTCACTGGGTCCGCCAGGCTCCAGGCAAGGGGC TGGAGTGGGTGGCACTTATATGGTATGATGGAA GTAATAAAGACTATGCAGACTCCGTGAAGGGCC GATTCACCATCTCCAGAGACAATTCCAAGAACA CGCTGTATCTGCATGTGAACAGCCTGAGAGCCG AGGACACGGCTGTGTATTACTGTGCGAGAGAAG GGACAACTCGACGGGATTTGACTACTGGGGCC AGGGAACCCTGGTCACCGTCTCCTCA |
| 64H5 | V_H7 | 522 | CAGGTGCAGCTGGTGGAGTCTGGGGGAGGAGTG GTCCAGCCTGGGAGGTCCCTGAGACTCTCCTGT GCAGCGTCTGGATTCACCTTCAGTAGCTATGGC ATGCACTGGGTCCGCCAGGCTCCAGGCAAGGGG CTGGAGTGGGTGGCAGTTATATGGGATGATGGA AGTAATAAATACTATGCAGACTCCGTGAAGGGC CGATTCACCATCTCCAGAGACAATTCCAAGAAC ACGCTGTCTCTGCAAATGAACAGCCTGAGGGCC GAGGACACGGCTGTTTATTACTGTGCGAGAGAA TACGTAGCAGAAGCTGGTTTTGACTACTGGGGC CAGGGAACCCTGGTCACCGTCTCCTCA |
| 65D4 | V_H25 | 523 | CAGGAGCAGCTGGTGGAGTCTGGGGGAGGCGTG GTCCAGCCTGGGAGGTCCCTGAGACTCTCCTGT GCAGTGTCTGGATTCACCTTCAGTTTCTATGGCA TGCACTGGGTCCGCCAGGCTCCAGGCAAGGGGC TGGAGTGGGTGGCAGTTATATGGTATGATGGAA GTAATAAATACTATGCAGACTCCGTGAAGGGCC GATTCACCATCTCCAGAGACAATTCCAAGAACA CGCTGTATTTGCAAATGAACAGCCTGAGAGCCG AGGACACGGCTGTGTATTACTGTACGAGAGCCC TCAACTGGAACTTTTTTGACTACTGGGGCCAGG GAACCCTGGTCACCGTCTCCTCA |
| 65E3 | V_H24 | 524 | CAGGTGCAGCTGGTGGAGTCTGGGGGAGGCGTG GTCCAGCCTGGGAGGTCCCTGAGACTCTCCTGT GCAGCGTCTGGATTCACCCTCAGTAACTATAAC ATGCACTGGGTCCGCCAGGCTCCAGGCAAGGGG CTGGAGTGGGTGGCAGTTTTATGGTATGATGGA AATACTAAATACTATGCAGACTCCGTGAAGGGC CGAGTCACCATCTCTAGAGACAATTCCAAGAAC ACGCTGTATCTTCAAATGAACAGCCTGAGAGCC GAGGACACGGCTGTGTATTACTGTGCGAGAGAT GTCTACGGTGACTATTTTGCGTACTGGGGCCAG GGAACCCTGGTCACCGTCTCCTCA |
| 65G4 | V_H8 | 525 | CAGGTGCAGCTGGTGGAGTCTGGGGGAGGCGTG GTCCAGCCTGGGAGGTCCCTGAGACTCTCCTGT GCAGCGTCTGGATTCACCTTCAGTAGCTATGGC ATGCACTGGGTCCGCCAGGCTCCAGGCAAGGGG CTGGAGTGGGTGGCAGTTATATGGGATGATGGA AGTAATAAATACTATGCAGACTCCGTGAAGGGC CGATTCACCATCTCCAGAGACAATTCCAAGAAC ACGCTGTCTCTGCAAATGAACAGCCTGAGGGCC GAGGACACGGCTGTTTATTACTGTGCGAGAGAA TACGTAGCAGAAGCTGGTTTTGACTACTGGGGC CAGGGAACCCTGGTCACCGTCTCCTCA |
| 68G5 | V_H12 | 526 | CAGGTGCAGCTGGTGGAGTCTGGGGGAGGCGTG GTCCAGCCTGGGAGGTCCCTGAGACTCTCCTGT ACAGCGTCTGGATTCACCTTCAGTAGCTATGGC ATGCACTGGGTCCGCCAGGCTCCAGGCAAGGGG CTGGAGTGGGTGGCAGTTATATGGTATGATGGA AGTAATAAATACCATGCAGACTCCGTGAAGGGC CGATTCACCATCTCCAGAGACGATTCCAAGAAC GCGCTTTATCTGCAAATGAACAGCCTGAGAGCC GAGGACACGGCTGTGTATTACTGTGTGAGAGAT CCTGGATACAGCTATGGTCACTTTGACTACTGGG GCCAGGGAACCCTGGTCACCGTCTCCTCA |

TABLE 2D-continued

Coding Sequence for Antibody Variable Heavy ($V_H$) Chains

| Contained in Clone | Designation | SEQ ID NO. | Coding Sequence |
|---|---|---|---|
| 67G8 | $V_H$27 | 527 | CAGGTGCAGCTGGTGGAGTCTGGGGGAGGCGTG GTCCAGCCTGGGAGGTCCCTGAGACTCTCCTGT GCAGCGTCTGGATTCACCTTCAGTAGCTATGGC ATGCACTGGGTCCGCCAGGCTCCAGGCAAGGGG CTGGAGTGGGTGGCAGTTATATGGTATGATGGA AGTAATAAAGACTATGCAGACTCCGTGAAGGGC CGATTCACCATCTCCAGAGACAATTCCAAGAAC ACGCTGTATCTGCAAATGAACAGCCTGAGAGCC GAGGACACGGCTGTGTATTACTGTGCGAGATCA GCAGTGGCTTTGTACAACTGGTTCGACCCCTGG GGCCAGGGAACCCTGGTCACCGTCTCCTCA |
| 65B7v1 65B7v2 | $V_H$28 | 528 | CAGGTGCAGCTGCAGGAGTCGGGCCCAGGACTG GTGAACCCTTCACAGACCCTGTCCCTCACCTGCA CTGTCTCTGGTGGCTCCATCAGCAGTGATGCTTA CTACTGGAGCTGGATCCGCCAGCACCCAGGGAA GGGCCTGGAGTGGATTGGGTACATCTTTTACAG TGGGAGCACCTACTACAACCCGTCCCTCAAGAG TCGAGTTACCATTTCAGTAGACACGTCTAAGAA CCGGTTCTCCCTGAAGCTGAGCTCTGTGACTGCC GCGGACACGGCCGTGTATTACTGTGCGAGAGAG TCTAGGATATTGTACTTCAACGGGTACTTCCAGC ACTGGGGCCAGGGCACCCTGGTCACCGTCTCCT CA |
| 63B6 64D4 | $V_H$4 | 529 | CAGGTGCAGCTGCAGGAGTCGGGCCCAGGACTG GTGAAGCCTTCACAGACCCTGTCCCTCACCTGCG CTGTCTCTGGTGGCTCCATCAGCAGTGGTGATTA CTACTGGAGCTGGATCCGCCAGCACCCAGGGAA GGGCCTGGAGTGGATTGGGTACATCTATTACAG TGGGACCACCTACTACAACCCGTCCCTCAAGAG TCGAGTTACCATATCAGTAGACACGTCCAAGAA CCAGTTCTCCCTGAAGCTGACCTCTGTGACTGCC GCGGACACGGCCGTATATTACTGTGCGAGAATG ACTACTCCTTACTGGTACTTCGGTCTCTGGGGCC GTGGCACCCTGGTCACTGTCTCCTCA |
| 63F5 | $V_H$13 | 530 | CAGGTGCAGCTGCAGGAGTCGGGCCCAGGACTG GTGAAGCCTTCACAGACCCTGTCCCTCACCTGCC CTGTCTCTGGTGGCTCCATCAGCAGTGGTGATTA TTACTGGACCTGGATCCGCCAGCACCCAGGGAA GGACCTGGAGTGGATTACATACATCTATTACAG TGGGAGCGCCTACTACAACCCGTCCCTCAAGAG TCGAGTTACCATATCAGTAGACACGTCTAAGAA CCAGTTCTCCCTGAAGCTGAGCTCTGTGACTGCC GCGGACACGGCCGTATATTATTGTGCGAGGATG ACTACCCCTTATTGGTACTTCGATCTCTGGGGCC GTGGCACCCTGGTCACTGTCTCCTCA |
| 63H11 | $V_H$3 | 531 | CAGGTGCAGCTGCAGGAGTCGGGCCCAGGACTG GTGAAGCCTTCACAGACCCTGTCCCTCACCTGCC CTGTCTCTGGTGGCTCCATCAGCAGTGGTGATTA CTACTGGACCTGGATCCGCCAGCACCCAGGGAA GGGCCTGGAGTGGATTGCATACATCTATTACAG TGGGAGCACCTACTACAACCCGTCCCTCAAGAG TCGAGTTACCATATCAGTAGACACGTCTAAGAA CCAGTTCTCCCTGAAGCTGAGCTCTGTGACTGCC GCGGACACGGCCGTATATTACTGTGCGAGGATG ACTACCCCTTACTGGTACTTCGATCTCTGGGGCC GTGGCACCCTGGTCACTGTCTCCTCA |
| 65E8 64E6 65F11 67G7 | $V_H$2 | 532 | CAGGTGCAGCTGCAGGAGTCGGGCCCAGGACTG GTGAAGCCTTCACAGACCCTGTCCCTCACCTGCC CTGTCTCTGGTGGCTCCATCAGCAGTGGTGATTA CTACTGGACCTGGATCCGCCAGCACCCAGGGAA GGGCCTGGAGTGGATTGCATACATCTATTACAC TGGGAGCACCTACTACAACCCGTCCCTCAAGAG TCGAGTTACCATATCAGTAGACACGTCTAAGAA CCAGTTCTCCCTGAAGCTGAGCTCTGTGACTGCC GCGGACACGGCCGTATATTACTGTGCGAGGATG ACTACCCCTTACTGGTACTTCGATCTCTGGGGCC GTGGCACCCTGGTCACTGTCTCCTCA |
| 65C1 | $V_H$15 | 533 | CAGGTGCAGCTGCAGGAGTCGGGCCCAGGACTG GTGAAGCCTTCACAGACCCTGTCCCTCACCTGCC |

TABLE 2D-continued

Coding Sequence for Antibody Variable Heavy (V$_H$) Chains

| Contained in Clone | Designation | SEQ ID NO. | Coding Sequence |
|---|---|---|---|
| | | | CTGTCTCTGGTGGCTCCATCAGCAGTGGTGATTA CTACTGGACCTGGATCCGCCAACACCCAGGGAA GGGCCTGGAGTGGATTGCATACATTTTTTACAGT GGGAGCACCTACTACAACCCGTCCCTCAAGAGT CGAGTTACCATATCACTTGACACGTCTAAGAAC CAGTTCTCCCTGAAGCTGAACTCTGTGACTGCCG CGGACACGGCCGTATATTACTGTGCGAGGATGA CTTCCCCTTACTGGTACTTCGATCTCTGGGGCCG TGGCACCCTGGTCACTGTCTCCTCA |
| 66F6 | V$_H$14 | 534 | CAGGTGCAGCTGCAGGAGTCGGGCCCAGGACTG GTGAAGCCTTCACAGACCCTGTCCCTCACCTGCC CTGTCTCTGGTGGCTCCATCAGCAGTGGTGATTA CTACTGGACCTGGATCCGCCATCACCCAGGGAA GGGCCTGGAGTGGATTGCATACATTTATTACAG TGGGAGCACCTACTACAACCCGTCCCTCAAGAG TCGAGTTACCATATCAGTTGACACGTCTAAGAA CCAGTTTTCCCTGAAGCTGAACTCTGTGACTGCC GCGGACACGGCCGTTTATTACTGTGCGAGGATG ACTACCCCTTACTGGTACTTCGATCTCTGGGGCC GTGGCACCCTGGTCACTGTCTCCTCA |
| 64A6 | V$_H$29 | 535 | CAGGTGCAGCTGCAGGAGTCGGGCCCAGGACTG GTGAAGCCTTCACAGACCCTGTCCCTCACCTGCA CTGTCTCTGGTGGCTCCATCAGCAGTGGTGGTTA TTACTGGAGCTGGATCCGCCAGCGCCCAGGGAA GGGCCTGGAGTGGGTTGGGTACATCTATTACAG TGGGGGCACCCACTACAACCCGTCCCTCAAAAG TCGAGTTACCATATCAATAGACACGTCTGAGAA CCAGTTCTCCCTGAAGCTGAGTTCTGTGACTGCC GCGGACACGGCCGTGTATTACTGTGCGAGAGTC CTCCATTACTCTGATAGTCGTGGTTACTCGTACT ACTCTGACTTCTGGGGCCAGGGAACCCTGGTCA CCGTCTCCTCA |
| 65F9 | V$_H$30 | 536 | CAGGTGCAGCTGCAGGAGTCGGGCCCAGGACTG GTGAAGCCTTCACAGACCCTGTCCCTCACCTGCA CTCTCTCTGGTGGCTCCTTCAGCAGTGGTGATTA CTACTGGAGCTGGATCCGCCAGCACCCAGGGAA GGGCCTGGAGTGGATTGGGTACATCTATTACAG TGGGAGCACCTACTACAACCCATCCCTCAAGAG TCGAGTTACCATATCAATAGACACGTCTAAGAA CCAGTTCTCCCTGAAACTGACCTCTGTGACTGCC GCGGACACGGCCGTGTATTACTGTGCGAGAGTC CTCCATTACTATGATAGTAGTGGTTACTCGTACT ACTTTGACTACTGGGGCCAGGGAACCCTGGTCA CCGTCTCCTCA |
| 64A7 | V$_H$16 | 537 | CAGCTGCAGCTGCAGGAGTCGGGCCCAGGACTG GTGAAGCCTTCGGAGACCCTGTCCCTCACCTGC ACTGTCTCTGGTGGCTCCATCAGCAGTGATACTT CCTACTGGGGCTGGATCCGCCAGCCCCCAGGAA AGGGGCTGGAGTGGATTGGGAATATCTATTATA GTGGGACCACCTACTTCAACCCGTCCCTCAAGA GTCGAGTCAGCGTATCCGTAGACACATCCAAGA ACCAGTTCTCCCTGAAGCTGAGCTCTGTGACCGC CGCAGACACGGCTGTGTTTATTGTGCGAGACTC CGAGGGGTCTACTGGTACTTCGATCTCTGGGGC CGTGGCACCCTGGTCACTGTCTCCTCA |
| 65C3 68D5 | V$_H$5 | 538 | CAGGTGCAGCTACAGGAGTCGGGTCCAGGACTG GTGAAGCCTTCGGAGACCCTGTCCCTCACCTGC ACTGTCTCTGGTGGCTCCATCAGTAGTTACTACT GGAGCTGGATCCGGCAGCCCCAGGGAAGGGA CTGGAGTGGATTGGGTATATCTATTACACTGGG AGCACCAACTACAACCCCTCCCTCAAGAGTCGA GTCACCATATCAGTAGACACGTCCAAGAACCAG TTCTCCCTGAAGCTGAGCTCTGTGACCGCTGCGG ACACGGCCGTGTATTACTGTGCGAGAGAATATT ACTATGGTTCGGGGAGTTATTATCCTTGGGGCCA GGGAACCCTGGTCACCGTCTCCTCA |
| 67F5 | V$_H$31 | 539 | CAGGTGCAGCTGAAGGAGTCGGGCCCAGGACTG GTGAAGCCTTCGGAGACCCTGTCCCTC ACCTGCACTGTCTCTGGTGGCTCCATCAGTAGTT |

TABLE 2D-continued

Coding Sequence for Antibody Variable Heavy (V_H) Chains

| Contained in Clone | Designation | SEQ ID NO. | Coding Sequence |
|---|---|---|---|
| | | | ACTACTGGAGCTGGATCCGGCAGCCC CCAGGGAAGGGACTGGAGTGGATTGGGTATATC TATTACAGTGGGAACACCAACTACAAC CCCTCCCTCAAGAGTCGAGTCACCATATCAGTA GACACGTCCAAGAACCAGTTCTCCCTG AAGCTGAGCTCTGTGACCGCTGCGGACACGGCC GTGTATTACTGTGCGAGAGAATATTAC TATGGTTCGGGGAGTTATTATCCTTGGGGCCAG GGAACCCTGGTCACCGTCTCCTCA |
| 64B10v1 | V_H32 | 540 | CAGATTCAGCTGCTGGAGTCGGGCCCAGGACTG GTGAAGCCTTCGGAGACCCTGTCCCTCACCTGC ACTGTCTCTGGTGGCTCCGTCAGTAGTGGTGATT ACTACTGGAGCTGGATCCGGCAGCCCCCAGGGA AGGGACTGGAGTGGATTGGGTTTATCTATTACA GTGGGGGCACCAACTACAACCCCTCCCTCAAGA GTCGAGTCACCATATCAATAGACACGTCCAAGA ACCAGTTCTCCCTGAAGCTGAACTCTGTGACCGC TGCGGACACGGCCGTGTATTACTGTGCGAGATA TAGCAGCACCTGGGACTACTATTACGGTGTGGA CGTCTGGGGCCAAGGGACCACGGTCACCGTCTC CTCA |
| 64B10v2 | V_H96 | 1867 | CAGGTGCAGCTGCTGGAGTCGGGCCCAGGACTG GTGAAGCCTTCGGAGACCCTGTCCCTCACCTGC ACTGTCTCTGGTGGCTCCGTCAGCAGTGGTGATT ACTACTGGAGCTGGATCCGGCAGCCCCCAGGGA AGGGACTGGAGTGGATTGGGTTTATTTATTACA GTGGGGGCACCAACTACAACCCCCCCCTCAAGA GTCGAGTCACCATATCAATAGACACGTCCAAGA ACCAGTTCTCCCTGAAGCTGAGTTCTGTGACCGC TGCGGACACGGCCGTGTATTACTGTGCGAGATA TAGCAGCACCTGGGACTACTATTACGGTGTGGA CGTCTGGGGCCAAGGGACCACGGTCACC GTCTCCTCA |
| 68C8 | V_H33 | 541 | CAGGTGCAGCTGCAGGAGTCGGGCCCAGGACTG GTGAAGCCTTCGGAGACCCTGTCCCTCACCTGC ACTGTCTCTGGTGACTCTGTCAGCAGTGGTGATA ACTACTGGAGCTGGATCCGGCAGCCCCCAGGGA AGGGACTGGAGTGGATTGGGTTCATGTTTTACA GTGGGAGTACCAACTACAACCCCTCCCTCAAGA GTCGAGTCACCATATCACTACACACGTCCAAGA ACCAGTTCTCCCTGAGGCTGAGCTCTGTGACCGC TGCGGACACGGCCGTGTATTACTGTGGGAGATA TAGGAGTGACTGGGACTACTACTACGGTATGGA CGTCTGGGGCCAAGGGACCACGGTCACCGTCTC CTCA |
| 67A5 | V_H34 | 542 | GAGGTGCAGCTGGTGCAGTCTGGAGCAGAGGTG AAAAAGCCCGGGGAGTCTCTGAAGATCTCCTGT AAGGGTTCTGGATACAGCTTTACCAGTTACTGG ATCGGCTGGGTGCGCCAGATGCCCGGGAAAGGC CTGGAGTGGATGGGGATCATCTATCCTGGTGAC TCTGATACCAGATACAGCCCGTCCTTCCAAGGC CAGGTCACCATCTCAGCCGACAAGTCCATCAAC ACCGCCTACCTGCAGTGGAGCAGCCTGAAGGCC TCGGACACCGCCATATACTTCTGTGCGAGACGG GCCTCACGTGGATACAGATTTGGTCTTGCTTTTG CGATCTGGGGCCAAGGGACAATGGTCACCGTCT CCTCA |
| 67C10 | V_H35 | 543 | GAGGTGCAGCTGGTGCAGTCTGGAGCAGAGGTG AAAAAGCCCGGGGAGTCTCTGAAGATCTCCTGT CAGGGTTCTGGATACAGCTTTAGCAGTTACTGG ATCGGCTGGGTGCGCCAGATGCCCGGGAAAGGC CTGGAGTGGATGGGGATCATCTATCCTGGTGAC TCTGATACCAGATACAGCCCGTCCTTCCAAGGC CAGGTCACCATCTCAGCCGACAAGTCCATCAAT ACCGCCTACCTGCAGTGGAGCAGCCTGAAGGCC TCGGACACCGCCATATATTACTGTGCGAGACGG GCCTCACGTGGATACAGATATGGTCTTGCTTTTG CTATCTGGGGCCAAGGGACAATGGTCACCGTCT CTTCA |

TABLE 2D-continued

Coding Sequence for Antibody Variable Heavy (V$_H$) Chains

| Contained in Clone | Designation | SEQ ID NO. | Coding Sequence |
|---|---|---|---|
| 64H6 | V$_H$36 | 544 | GAGGTGCAGCTGGTGCAGTCTGGAGCAGAGGTG AAAAAGCCCGGGGAGTCTCTGAAGATCTCCTGT AAGGGTTCTGGATACAGTTTTACCAGTTATTGGA TCGGCTGGGTGCGCCAGATGCCCGGGAAAGGCC TGGAGTGGATGGGGATCATCTATCCTGGTGACT CTGAAACCAGATACAGCCCGTCCTTTCAAGGCC AGGTCACCATCTCAGCCGACAAGTCCATCAGCA CCGCCTACCTGCAGTGGAACAGCCTGAAGACCT CGGACACCGCCATGTATTTCTGTGCGACCGTAG CAGTGTCTGCCTTCAACTGGTTCGACCCCTGGGG CCAGGGAACCCTGGTCACCGTCTCCTCC |
| 63F9 | V$_H$37 | 545 | CAGGTGCAGCTGAAGGAGTCGGGCCCAGGACTG GTGAAGCCTTCACAGACCCTGTCCCTCACCTGCA CTGTCTCTGGTGGCTCCATCAGCAGTGGTGGTTA CTACTGGAACTGGATCCGCCAGCACCCAGGGAA GGGCCTGGAGTGGATTGGGTACATCTATGACAG TGGGAGCACCTACTACAACCCGTCCCTCAAGAG TCGAGTTACCATGTCAGTAGACACGTCTAAGAA CCAGTTCTCCCTGAAGTTGAGCTCTGTGACTGCC GCGGACACGGCCGTGTATTACTGTGCGAGAGAT GTTCTAATGGTGTATACTAAAGGGGGCTACTAC TATTACGGTGTGGACGTCTGGGGCCAAGGGACC ACGGTCACCGTCTCCTCA |
| 67F6v1 67F6v2 | V$_H$38 | 546 | GAGGTGCAGCTGGTGCAGTCTGGAGCAGAGGTG AAAAAGCCCGGGGAGTCTCTGAAGATCTCCTGT AAGGGTTCTGGATACAGTTTTACCGGCTACTGG ATCGGCTGGGTGCGCCAGCTGCCCGGGAAAGGC CTGGAGTGGATGGGGATCATCTATCCTGGTGAC TCTGATACCAGATACAGCCCGTCCTTCCAAGGC CAGGTCACCATCTCAGTCGACAAGTCCATCAAC ACCGCCTACCTGCAGTGGAGCAGCCTGAAGGCC TCGGACACCGCCATGTATTACTGTGCGAGACGG GCCTCACGTGGATACAGCTATGGTCATGCTTTTG ATTTCTGGGGCCAAGGGACAATGGTCACCGTGT CTTCA |
| 48C9 49A12 51E2 | V$_H$73 | 547 | CAGGTGCAGCTACAGCAGTGGGGCGCAGGACTG TTGAAGCCTTCGGAGACCCTGTCCCTCACCTGCT CTGTCTATGGTGGGTCCTTCAGTGGTTACTACTG GACCTGGATCCGCCAGCCCCCAGGGAAGGGGCT GGAGTGGATTGGGGAAATCAATCATAGTGAAAA CACCAACTACAACCCGTCCCTCAAGAGTCGAGT CACCATATCAATAGACACGTCCAAGAACCAGTT CTCCCTGAAGCTGAGCTCTGTGACCGCCGCGGA CACGGCTGTGTATTACTGTGCGAGAGAGAGTGG GAACTTCCCCTTTGACTACTGGGGCCAGGGAAC CCTGGTCACCGTCTCCTCA |
| 48F3 | V$_H$72 | 548 | CAGGTGCAGCTACAGCAGTGGGGCGCAGGACCG TTGAAGCCTTCGGAGACCCTGTCCCTCACCTGCG CTGTCTATGGTGGGTCCATCAGTGGTTACTACTG GAGCTGGATCCGCCAGCCCCCAGGGAAGGGGCT GGAGTGGATTGGGGAAATCACTCATACTGGAAG CTCCAACTACAACCCGTCCCTCAAGAGTCGAGT CACCATATCAGTAGACACGTCCAAGAACCAGTT CTCCCTGAAGCTGAGCTCTGTGACCGCCGCGGA CACGGCTGTGTATTACTGTGCGAGAGGCGGGAT TTTATGGTTCGGGGAGCAGGCTTTTGATATCTGG GGCCAAGGGACAATGGTCACCGTCTCTTCA |
| 48F8 53B9 56B4 57E7 57F11 | V$_H$48 | 549 | GAGGTGCAGCTGGTGGAGTCTGGGGGAGGCCTG GTCAAGCCTGGGGGGTCCCTGAGACTCTCCTGT ACAGCCTCTGGATTCACCTTCAGAAGCTATAGC ATGAACTGGGTCCGCCAGGCTCCGGGGAAGGGG CTGGAGTGGGTCTCATCCATTAGTAGTAGTAGT AGTTACGAATACTACGTAGACTCAGTGAAGGGC CGATTCACCATCTCCAGAGACATCGCCAAGAGC TCACTGTGGCTGCAAATGAACAGCCTGAGAGCC GAGGACACGGCTGTGTATTACTGTGCGAGATCC CTAAGTATAGCAGTGGCTGCCTCTGACTACTGG GGCAAGGGAACCCTGGTCACCGTCTCCTCA |

TABLE 2D-continued

Coding Sequence for Antibody Variable Heavy (V_H) Chains

| Contained in Clone | Designation | SEQ ID NO. | Coding Sequence |
|---|---|---|---|
| 48H11 | $V_H39$ | 550 | CAGGTGCAACTGGTGCAGTCTGGGGCTGAGGTG<br>AAGAAGCCTGGGGCCTCAGTGAAGGTCTCCTGC<br>AAGGCTTCTGGATACACCTTCACCGGCTACTATA<br>AGCACTGGGTGCGACAGGCCCCTGGACAAGGGC<br>TTGAGTGGATGGGATGGATCAACCCTAACAGTG<br>GTGCCACAAAGTATGCACAGAAGTTTCAGGGCA<br>GGGTCACCATGACCAGGGACACGTCCATCAGCA<br>CAGTGTACATGGAGCTGAGCAGGCTGAGATCTG<br>TCGACACGGCCCTGTATTACTGTGCGAGAGAGG<br>TACCCGACGGTATAGTAGTGGCTGGTTCAAATG<br>CTTTTGATTTCTGGGGCCAAGGGACAATGGTCA<br>CCGTCTCTTCA |
| 49A10<br>48D4 | $V_H62$ | 551 | CAGGTGCACCTGGTGGAGTCTGGGGGAGGCGTG<br>GTCCAGCCTGGGAGGTCCCTGAGACTCTCCTGT<br>GCAGCGTCTGGATTCACCTTCAGTAACTATGGC<br>ATGCACTGGGTCCGCCAGGCTCCAGGCAAGGGG<br>CTGGAGTGGGTGGCAATTATATGGTATGATGGA<br>AGTAATAAAAACTATGCAGACTCCGTGAAGGGC<br>CGCTTCACCATCTCCAGAGACAATTCCAAGAAC<br>ACGCTGTATCTGGAAATGAACAGCCTGAGAGCC<br>GAGGACACGGCTGTGTATTACTGTGCGAGAGAT<br>CAGGATTACGATTTTTGGAGTGGTTATCCTTACT<br>TCTACTACTACGGTATGGACGTCTGGGGCCAAG<br>GGACCACGGTCACCGTCTCCTCA |
| 49C8<br>52H1 | $V_H44$ | 552 | CAGGTGCAGCTGGTGCAGTCTGGGGCTGAGGTG<br>AAGAAGCCTGGGGCCTCAGTGAAGGTCTCCTGC<br>AAGGCTTCTGGATACACCTTCACCAGTTATGATA<br>TCGACTGGGTGCGACAGGCCACTGGACAAGGGC<br>TTGAGTGGATGGGATGGATGAACCCTAACGGTG<br>GTAACACAGGCTATGCACAGAAGTTCCAGGGCA<br>GAGTCACCATGACCAGGAACACCTCCATAAACA<br>CGGCCTATATGGAACTGAGCAGCCTGAGATCTG<br>AGGACACGGCCATATATTACTGTGCGAGAGGGA<br>AGGAATTTAGCAGGCGGAGTTTGACTACTGGG<br>GCCAGGGAACCCTGGTCACCGTCTCCTCA |
| 49G2<br>50C12<br>55G11 | $V_H63$ | 553 | CAGGTGCAGCTGGTGGAGTCTGGGGGAGGCGTG<br>GTCCAGCCTGGGAGGTCCCTGAGACTCTCCTGT<br>GCAGCGTCTGGATTCACCTTCAGTAACTATGGC<br>ATGCGCTGGGTCCGCCAGGCTCCAGGCAAGGGG<br>CTGGAGTGGGTGGCACTTATATGGTATGATGGA<br>AGTAATAAGTTCTATGCAGACTCCGTGAAGGGC<br>CGATTCACCATCTCCAGAGACAATTCCAAGAAC<br>ACGCTGAATCTGCAAATGAACAGCCTGAGAGCC<br>GAGGACACGGCTGTGTATTACTGTGCGAGAGAT<br>CGGTATTACGATTTTTGGAGTGGTTATCCATACT<br>TCTTCTACTACGGTCTGGACGTCTGGGGCCAAG<br>GGACCACGGTCACCGTCTCCTCA |
| 49G3 | $V_H46$ | 554 | CAGGTCACCTTGAAGGAGTCTGGTCCTGTGCTG<br>GTGAAACCCACAGAGACCCTCACGCTGACCTGC<br>ACCGTCTCTGGGTTCTCACTCAGTAATCCTAGAA<br>TGGGTGTGAGCTGGATCCGTCAGCCCCCAGGGA<br>AGGCCCTGGAGTGGCTTACACACATTTTTTCGAA<br>TGACGAAAAATCCTACAGCACATCTCTGAAGAG<br>CAGGCTCACCATCTCCAAGGACACCTCCAAAAG<br>CCAGGTGGTCCTTTCCATGACCAACATGGACCCT<br>GTGGACACAGCCACATATTACTGTGTACGGGTA<br>GATACCTTGAACTACCACTACTACGGTATGGAC<br>GTCTGGGGCCAAGGGACCACGGTCACCGTCTCC<br>TCA |
| 49H12 | $V_H42$ | 555 | CAGGTGCAGCTGGTGCAGTCTGGGGCTGAGGTG<br>AAGAAGCCTGGGGCCTCAGTGAAGGTCTCCTGC<br>ATGGCATCTGGATACATTTTCACCAGTTACGATA<br>TCAACTGGGTGCGACAGGCCACTGGACAAGGGC<br>CTGAGTGGATGGGATGGATGAACCCCTACAGTG<br>GGAGCACAGGCTATGCACAGAATTTCCAGGGCA<br>GAGTCACCATGACCAGGAATACCTCCATAAACA<br>CAGCCTACATGGAGCTGAGCAGCCTGAGATCTG<br>AGGACACGGCCGTGTATTACTGTGCGAAGTATA<br>ATTGGAACTATGGGGCTTTTGATTTCTGGGGCCA<br>AGGGACAATGGTCACCGTCTCTTCA |

TABLE 2D-continued

Coding Sequence for Antibody Variable Heavy ($V_H$) Chains

| Contained in Clone | Designation | SEQ ID NO. | Coding Sequence |
|---|---|---|---|
| 51A8 | $V_H$58 | 556 | CAGGTGCAGCTGGTGGAGTCTGGGGGAGGCGTG GTCCAGCCTGGGAGGTCCCTGAGACTCTCCTGT GCAGCCTCTGGATTCACCTTCAGTAGCTATGGCA TGCACTGGGTCCGCCAGGCTCCAGGCAAGGGGC TGGAGTGGGTGGCAGTTATATCATATGATGGAA GTAATAAATACTATGCAGACTCCGTGAAGGGCC GATTCACCATCTCCAGAGACAATTCCAAGAACA CGTTGTATCTGCAAATGAACAGCCTGAGAGCTG AGGACACGGCTGTGTATTACTGTGCGAGAGCGG ACGGTGACTACCCATATTACTACTACTACTACGG TATGGACGTCTGGGGCCAAGGGACCACGGTCAC CGTCTCCTCA |
| 51C10.1 59D10v1 59D10v2 | $V_H$54 | 557 | GAGGTGCAGCTGTTGGAGTCTGGGGGAGGCTTG GTACAGCCGGGGGGGTCCCTGAGACTCTCCTGT GCAGCCTCTGGATTCACCTTTCGCAACTATGCCA TGAGCTGGGTCCGCCAGGCTCCAGGGAAGGGGC TGGAGTGGGTCTCAGGTATTAGTGGTAGTAGTG CTGGCACATACTACGCAGACTCCGTGAAGGGCC GGTTCACCATCTCCAGAGACAATTCCAAGAACA CGCTGTTTCTGCAAATGGACAGCCTGAGAGCCG AGGACACGGCCGTATATTACTGTGCGCAAGATT GGAGTATAGCAGTGGCTGGTACTTTTGACTACT GGGGCCAGGGAACCCTGGTCACCGTCTCCTCA |
| 51C10.2 | $V_H$67 | 558 | CAGGTGCAGCTGCAGGAGTCGGGCCCAGGACTG GTGAAGCCTTCACAGACCCTGTCCCTCACCTGCA CTGTCTCTGGTGGCTCCATCAGCAGTGGTGGTTA CTACTGGAGCTGGATCCGCCAGCACCCAGGGAA GGGCCTGGAGTGGATTGGGTACATCTATTACAA TGGGAGTCCCTACGACAACCCGTCCCTCAAGAG GCGAGTTACCATCTCAATAGATGCGTCTAAGAA CCAGTTCTCCCTGAAGCTGAGCTCTATGACTGCC GCGGACACGGCCGTGTATTACTGTGCGAGAGGG GCCCTCTACGGTATGGACGTCTGGGGCCAAGGG ACCACGGTCACCGTCTCCTCA |
| 51E5 | $V_H$74 | 559 | CAGGTGCAGCTACAGCAGTGGGGCGCAGGACTG TTGAAGCCTTCGGAGACCCTTTCCCTCACCTGCG CTGTCTATGGTGGGTCCTTCAGTGGTTACTACTG GAGCTGGATCCGCCAGCCCCCAGGGAAGGGGCT GGAGTGGATTGGGGAACTCGATCATAGTGGAAG TATCAACTACAACCCGTCCCTCAAGAGTCGAGT CACCATATCAGTAGACACGTCCAAGAACCAGTT CTCCCTGAAGCTGACCTCTGTGACCGCCGCGGA CACGGCTGTGTATTACTGTGCGAGAGTCCTGGG ATCTACTCTTGACTATTGGGGCCAGGGAACCCT GGTCACCGTCTCCTCA |
| 51G2 | $V_H$50 | 560 | GAGGTGCAGCTGGTGGAGTCTGGGGGAGGCCTG GTCAAGCCTGGGGGGTCCCTGAGACTCTCCTGT GCAGCCTCTGGATTCACCTTCAGTAGTTATAGCA TGAACTGGGTCCGCCAGGCTCCAGGGAAGGGGC TGGAGTGGGTCTCATCCATTAGTAGTAGTAGTA CTTACATATACTACGCAGACTCAGTGAAGGGCC GATTCACCATCTCCAGAGACAACGCCAAGAACT CACTGTATCTGCAAATGAACAGCCTGAGAGCCG AGGACACGGCTGTGTATTACTGTGCGAGAGATA CTTATATCAGTGGCTGGAACTACGGTATGGACG TCTGGGGCCAAGGGACCACGGTCACCGTCTCCT CA |
| 52A8 | $V_H$40 | 561 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATT TGCACTGGGTGCGACAGGCCCCTGGACAAGGGC TTGAGTGGATGGGATGGATCAACCCTAACAGTG CTGCCACAAACTATGCACCGAAGTTTCAGGGCA GGGTCACCGTGACCAGGGACACGTCCATCAGCA CAGCCTACATGGAACTGAGCAGGCTGAGATCTG ACGACACGGCCGTGTATTACTGTGCGAGAGAGG GTGGAACTTACAACTGGTTCGACCCCTGGGGCC AGGGAACCCTGGTCACCGTCTCCTCA |

TABLE 2D-continued

Coding Sequence for Antibody Variable Heavy (V$_H$) Chains

| Contained in Clone | Designation | SEQ ID NO. | Coding Sequence |
|---|---|---|---|
| 52B8 | V$_H$77 | 562 | CAGGTGCAGCTGCAGGAGTCGGGCCCAGGACTG ATGAAGCCTTCGGAGACCCTGTCCCTCACCTGC ACTGTCTCTGGTGGCTCCATCAGTTATTATTACT GGAGTTGGATCCGGCAGTCCCCAGGGAAGGGAC TGGAGTGGATTGGGTATATCTATTATAGTGGGA GCACCAACTACAACCCCTCCCTCAAGAGTCGAG TCACCATGTCAGTAGACACGTCCAAGAACCAGT TCTCCCTGAAGCTGAGCTCTGTGACCGCTGCGG ACACGGCCGTGTATTACTGTGCGTCTGGAACTA GGGCTTTTGATATCTGGGGCCAAGGGACAATGG TCACCGTCTCTTCA |
| 52C1 | V$_H$64 | 563 | CAGGTGCAGCTGGTGGAGTCTGGGGGAGGCGTG GTCCAGCCTGGGAGGTCCCTGAGACTCTCCTGT GCAGCGTCTGGATTCACCTTCAGTAGCTATGGC ATGCACTGGGTCCGCCAGGCTCCAGGCAAGGGC CTGGAGTGGGTGGCAGTTATATGGTATGATGGA AGTAATAACTATTATGCAGACTCCGTGAAGGGC CGATTCACCATCTCCAGAGACAATTCCAAGAGC ACGCTGTTTCTGCAAATGAACAGCCTGAGAGCC GAGGACACGGCTATATATTACTGTGCGAGAGAT CGGGCGGGAGCCTCTCCCGGAATGGACGTCTGG GGCCAAGGGACCACGGTCACCGTCTCCTCA |
| 52F8 | V$_H$41 | 564 | CAGGTGCAACTGGTGCAGTCTGGGGCGGAGGTG AAGAAGCCTGGGGCCTCAGTGAAGGTCTCCTGC AAGGCTTCTGGATTCACCTTCATCGGCTACTATA CACACTGGGTGCGACAGGCCCCTGGACAAGGGC TTGAGTGGATGGGATGGATCAACCCTAGCAGTG GTGACACAAAGTATGCACAGAAGTTTCAGGGCA GGGTCACCTTGGCCAGGGACACGTCCATCAGCA CAGCCTACATGGAGCTGAGCAGGCTGAGATCTG ACGACACGGCCGTGTATTACTGTGCGAACAGTG GCTGGTACCCGTCCTACTACTACGGTATGGACGT CTGGGGCCAAGGGACCACGGTCACCGTCTCCTCA |
| 52H2 | V$_H$79 | 565 | CAGGTGCAGCTGCAGGAGTCGGGCCCAGGACTG GTGAAGCCTTCGGAGACCCTGTCCCTCACCTGC ACTGTCTCTGGTGGCTCCATCAGTACTTACTACT GGAGCTGGATCCGGCAGCCCCCAGGGACGGGAC TGGAATGGATTGGGTATATCTTTTACAATGGGA ACGCCAACTACAGCCCCTCCCTGAAGAGTCGAG TCACCTTTTCAGTGGACACGTCCAAGAACCAGTT CTCCCTGAAACTGAGTTCTGTGACCGCTGCGGA CACGGCCGTGTATTTTGTGCGAGAGAAACGGA CTACGGTGACTACGCACGTCCTTTTGAATACTGG GGCCAGGGAACCCTGGTCACCGTCTCCTCA |
| 53F6 | V$_H$60 | 566 | CAGGTGCAGCTGGTGGAGTCTGGGGGAGGCGTG GTCCAGCCTGGGAGGTCCCTGAGACTCTCCTGT GCAGCGTCTGGATTCACCTTCAGTACCTATGGCA TGCACTGGGTCCGCCAGGCTCCAGGCAAGGGGC TGGAGTGGGTGGCAGTTATATGGTATGATGGAA GTAATAAATACTATGCAGACTCCGTGAAGGGCC GATTCACCATCTCCAGAGACAATTCCAAGAACA CGCTGTATCTGCAAATGAACAGCCTGAGAGCCG AGGACACGGCTGTGTATTACTGTGCGAGAGGCC ACTATGATAGTAGTGGTCCCAGGGACTACTGGG GCCAGGGAACCCTGGTCACCGTCTCCTCA |
| 53H5.2 | V$_H$59 | 567 | CAGGTGCAGCTGGTGGAGTCTGGGGGAGGCGTG GTCCAGCCTGGGAGGTCCCTGAGACTCTCCTGT GCAGCCTCTGGATTCACCTTCAGTAGCTATGGCA TGCACTGGGTCCGCCAGGCTCCAGGCCAGGGGC TGGAGTGGGTGGCACTTATATCATATGATGGAA GTAATAAATACTATGCAGACTCCGTGAAGGGCC GATTCACCATCTCCAGAGACAAATCCAAGAACA CGCTGTATCTGCAAATGAACAGCCTGAGAGCTG AGGACACGGCTGTATATTACTGTGCGAGAGAGG CTAACTGGGGCTACAACTACTACGGTATGGACG TCTGGGGCCAAGGGACCACGGTCACCGTCTCCT CA |
| 53H5.3 | V$_H$75 | 568 | CAGGTGCAGCTACAGCAGTGGGGCGCAGGACTG TTGAAGCCTTCGGAGACCCTGTCCCTCACCTGCG |

TABLE 2D-continued

Coding Sequence for Antibody Variable Heavy (V_H) Chains

| Contained in Clone | Designation | SEQ ID NO. | Coding Sequence |
|---|---|---|---|
| | | | CTGTCTATGGTGGGTCCTTCAGTGATTACTACTG GAACTGGATCCGCCAGCCCCAGGGAAGGGGCC AGAGTGGATTGGGGAAATCAATCATAGTGGAAC CACCAACTACAATCCGTCCCTCAAGAGTCGAGT CACCATATCAGTAGACACGTCCAAGAACCAGTT CTCCCTGAAGCTGAGCTCTGTGACCGCCGCGGA CACGGCTGTATATTACTGTGTGGGGATATTACG ATATTTTGACTGGTTAGAATACTACTTTGACTAC TGGGGCCAGGGAACCCTGGTCACCGTCTCCTCA |
| 54A1 55G9 | V_H43 | 569 | CAGGTGCAGCTGGTGCAGTCTGGGGCTGAGGTG AAGAAGCCTGGGGCCTCAGTGAAGGTCTCCTGC AAGGCTTCTGGATACACCTTCACCAGTTATGATA TCAACTGGGTGCGACAGGCCACTGGACAAGGGC TTGAGTGGATGGGATGGATGAACCCTCACAGTG GTAACACAGGCTATGCACAGAAGTTCCAGGGCA GAGTCACCATGACCAGGAACACCTCCATAAATA CAGCCTACATGGAGCTGAGCAGCCTGAGATCTG AGGACACGGCCGTGTATTACTGTGCGAAATATA ACTGGAACTACGGCGCTTTTGATTTCTGGGGCCA AGGGACAATGGTCACCGTCTCTTCA |
| 54H10.1 55D1 48H3 53C11 | V_H52 | 570 | GAGGTGCAGCTGTTGGAGTCTGGGGGAGGCTTG GTACAGCCTGGGGGGTCCCTGAGACTCTCCTGT GCAGCCTCTGGATTCACCTTTAGCAGCTATGCCA TGAGCTGGGTCCGCCAGGCTCCGGGGAAGGGGC TGGAGTGGGTCTCAGCTATTAGTGGTAGTGGTC GTACCACATACTCCGCAGACTCCGTGAAGGGCC GGTTCACCATCTCCAGAGACAATTCCAAGAACA CGCTGTATCTGCAAATGAACAGCCTGAGAGCCG AGGACACGGCCGTATATTACTGTGCGAAAGAAC AGCAGTGGCTGGTTTATTTTGACTACTGGGGCCA GGGAACCCTGGTCACCGTCTCCTCA |
| 55D3 | V_H68 | 571 | CAGGTGCAGCTGCAGGAGTCGGGCCCAGGACTG GTGAAGCCTTCACAGACCCTGTCCCTCACCTGCA CTGTCTCTGGTGGCTCCATCACCAGTGGTGTTTA CTACTGGAACTGGATCCGCCAGCACCCAGGGAA GGGCCTGGAGTGGATTGGGTACCTCTATTACAG TGGGAGCACCTACTACAACCCGTCCCTCAAGAG TCGCCTTACCATTTCAGCAGACATGTCTAAGAAC CAGTTCTCCCTAAAGCTGAGCTCTGTGACTGTCG CGGACACGGCCGTGTATTACTGTGCGAGAGATG GTATTACTATGGTTCGGGGAGTTACTCACTACTA CGGTATGGACGTCTGGGGCCAAGGGACCACGGT CACCGTCTCCTCA |
| 55E4 49B11 50H10 53C1 52C5 60G5.1 | V_H70 | 572 | CAGGTGCAGCTACAGCAGTGGGGCGCAGGACTG TTGAAGCCTTCGGAGACCCTGTCCCTCACTTGCG CTGTCTATGGTGGGTCCTTCAGTGGTTACTACTG GAGCTGGATCCGCCAGCCCCAGGGAAGGGTCT GGAGTGGATTGGGGAAATCAATCATAGTGAAAA CACCAACTACAACCCGTCCCTCAAGAGTCGAGT CACCATATCACTAGACACGTCCAATGACCAGTT CTCCCTAAGACTAACCTCAGTGACCGCCGCGGA CACGGCTGTCTATTACTGTGCGAGAGTAACTGG AACGGATGCTTTTGATTTCTGGGGCCAAGGGAC AATGGTCACCGTCTCTTCA |
| 55E9 | V_H65 | 573 | CAGGTGCAGCTGGTGGAGTCTGGGGGAGGCGTG GTCCAGCCTGGGAGGTCCCTGAGACTCTCCTGT GCAGCGTCTGGATTCACCTTCAGTAGCTTTGGCA TGCACTGGGTCCGCCAGGCTCCAGGCAAGGGGC TGGAGTGGGTGGCACTTATATGGTATGATGGAG ATAATAAATACTATGCAGACTCCGTGAAGGGCC GATTCACCATCTCCAGAGACAATTCCAAGAACA CGCTGTATCTGCAAATGAACAGCCTGAGAGCCG AGGACACGGCTGTGTATTACTGTGCGAGAAACA GTGGCTGGGATTACTTCTACTACTACGGTATGGA CGTCTGGGGCCAAGGGACCACGGTCACCGTCTC CTCA |
| 55G5 | V_H78 | 574 | CAGGTGCAGCTGCAGGAGTCGGGCCCAGGACTG GTGAAGCCTTCGGAGACCCTGTCCCTCACCTGC ACTGTCTCTGGTGGCTCCATCAGTAGTTACTACT |

TABLE 2D-continued

Coding Sequence for Antibody Variable Heavy (V_H) Chains

| Contained in Clone | Designation | SEQ ID NO. | Coding Sequence |
|---|---|---|---|
| | | | GGAGCTGGATCCGGCAGCCCGCGGGAAGGGA<br>CTGGAGTGGATTGGGCGTATCTATATCAGTGGG<br>AGCACCAACTACAACCCCTCCCTCGAGAATCGA<br>GTCACCATGTCAGGAGACACGTCCAAGAACCAG<br>TTCTCCCTGAAGCTGAATTCTGTGACCGCCGCGG<br>ACACGGCCGTATATTACTGTGCGGGAAGTGGGA<br>GCTACTCCTTTGACTACTGGGGCCAGGGAACCC<br>TGGTCACCGTCTCCTCA |
| 50G1 | V_H84 | 575 | CAGGTGCAGTTGGTGGAGTCTGGGGGAGGCGTG<br>GTCCAGCCTGGGAGGTCCCTGAGACTCTCCTGT<br>GCAGCGTCTGGATTCACCTTCAGTAGCTATGGCC<br>TGCACTGGGTCCGCCAGGCTCCAGGCAAGGGGC<br>TGGAGTGGGTGGCAGTTATATGGAATGATGGAA<br>GTAATAAGCTTTATGCAGACTCCGTGAAGGGCC<br>GATTCACCATCTCCAGAGACAATTCCAAGAACA<br>CGCTGTATCTGCAAATGAACAGCCTGAGAGCCG<br>AGGACACGGCTGTGTATTACTGTGCGAGAGATC<br>AGTATTACGATTTTTGGAGCGGTTACCCATACTA<br>TCACTACTACGGTATGGACGTCTGGGGCCAAGG<br>GACCACGGTCACCGTCTCCTCA |
| 56A7<br>56E4 | V_H51 | 576 | GAGGTGCAGCTGGTGGAGTCTGGGGGAGGCCTG<br>GTCAAGCCTGGGGGGTCCCTGAGACTCTCCTGT<br>GCAGCCTCTGGATTCACCTTCAGTAGTTATAGCA<br>TGAACTGGGTCCGCCAGGCTCCAGGGAAGGGGC<br>TGGAGTGGGTCTCATCCATTAGTAGTAGTAGTA<br>CTTACATATACTACGCAGACTCAGTGAAGGGCC<br>GATTCACCATCTCCAGAGACAACGCCAAGAACT<br>CACTGTATCTGCAAATGAACAGCCTGAGAGCCG<br>AGGACACGGCTGTGTATTACTGTGCGAGAGATA<br>TCTATAGCAGTGGCTGGAGCTACGGTATGGACG<br>TCTGGGGCCAAGGGACCACGGTCACCGTCTCCT<br>CA |
| 56C11 | V_H61 | 577 | CAGGTGCAGCTGGTGGAGTCTGGGGGAGGCGTG<br>GTCCAGCCTGGGAGGTCCCTGAGACTCTCCTGT<br>GCAGCGTCTGGATTCACCTTCAGTAGCTATGGC<br>ATGCACTGGGTCCGCCAGGCTCCAGGCAAGGGA<br>CTGGAGTGGGTGGCAGTTATATGGTATGATGGA<br>AGTTATCAATTCTATGCAGACTCCGTGAAGGGC<br>CGATTCACCATCTCCAGAGACAATTCCAAGAAC<br>ACGTTGTATCTGCAAATGAACAGCCTGAGAGCC<br>GAGGACACGGCTGTGTATTACTGTGCGAGAGAT<br>CACGTTTGGAGGACTTATCGTTATATCTTTGACT<br>ACTGGGGCCAGGGAACCCTGGTCACCGTCTCCT<br>CA |
| 56E7 | V_H81 | 578 | GAGGTGCAGCTGGTGCAGTCTGGACCAGAGGTG<br>AAAAAGCCCGGGGAGTCTCTGAAGATCTCCTGT<br>AAGGGTTCGGGATACAGTTTAACCAGCTACTGG<br>ATCGGCTGGGTGCGCCAGATGCCCGGGAAAGGC<br>CTGGAGTGGATGGGGATCATCTATCCTGGTGAC<br>TCTGATACCAGATACAGCCCGTCCTTCCAAGGC<br>CAGGTCACCATCTCAGCCGACACGTCCATCAGC<br>ACCGCCTACCTGCAGTGGAGCAGGTTGAAGGCC<br>TCGGACACCGCCGTATATTACTGTGCGAGGGCA<br>CAACTGGGGATCTTTGACTACTGGGGCCAGGGA<br>ACCCTGGTCACCGTCTCCTCA |
| 56G1 | V_H71 | 579 | CAGGTGCAACTACAGCAGTGGGGCGCAGGACTG<br>TTGAAGCCTTCGGAGACCCTGTCCCTCACTTGCG<br>CTGTCTATGGTGGGTCCTTCAGTGGTTACTACTG<br>GAGCTGGATCCGCCAGCCCCCAGGGAAGGGTCT<br>GGAGTGGATTGGGAAATCAATCATAGTGAAAA<br>CACCAACTACAACCCGTCCCTCAAGAGTCGAGT<br>CACCATATCACTAGACACGTCCAATAAGCAGTT<br>CTCCCTAAGACTAACCTCTGTGACCGCCGCGGA<br>CACGGCTGTCTATTACTGTGCGAGAGTAACTGG<br>AACGGATGCTTTTGATTTCTGGGGCCAAGGGAC<br>AATGGTCACCGTCTCTTCA |
| 56G3.3<br>55B10 | V_H76 | 580 | CAGTTGCAGTTGCAGGAATCGGGCCCAGGACTG<br>GTGAAGCCTTCGGAGACCCTGTCCCTCACCTGC<br>ACTGTCTCTGGTGACTCCATCAGTAGTAGTAGTT |

TABLE 2D-continued

Coding Sequence for Antibody Variable Heavy (V_H) Chains

| Contained in Clone | Designation | SEQ ID NO. | Coding Sequence |
|---|---|---|---|
| | | | ACTACTGGGGCTGGATCCGCCAGCCCCCAGGGA<br>AGGGGCTGGAGTGGATTGGGATGATCTATTATA<br>GTGGGACCACCTACTACAACCCGTCCCTCAAGA<br>GTCGAGTCACCATATCCGTAGACACGTCCAAGA<br>ATCAGTTTTCCCTGAAGCTGAGTTCTGTGACCGC<br>CGCAGACACGGCTGTGTATTATTGTGCGAGAGT<br>GGCAGCAGTTTACTGGTATTTCGATCTCTGGGGC<br>CGTGGCACCCTGGTCACTGTCTCCTCA |
| 57B12 | V_H69 | 581 | CAGGTGCAGCTGCAGGAGTCGGGCCCAGGACTG<br>GTGAAGCCTTCACAGACCCTGTCCCTCACCTGCA<br>CTGTCTCTGGTGGCTCCATCACCAGTGGTGTTTA<br>CTACTGGAGCTGGATCCGCCAGCTCCCAGGGAA<br>GGGCCTGGAGTGGATTGGGTACATCTATTACAG<br>TGGGAGCACCTACTACAACCCGTCCCTCAAGAG<br>TCGCCTTACCATATCAGCAGACACGTCTAAGAA<br>CCAGTTCTCCCTAAAGCTGAGCTCTGTGACTGTC<br>GCGGACACGGCCGTGTATTACTGTGCGAGAGAT<br>GGTATTACTATGGTTCGGGGAGTTACTCACTACT<br>ACGGTATGGACGTCTGGGGCCAAGGGACCACGG<br>TCACCGTCTCCTCA |
| 57D9 | V_H82 | 582 | CAGGTACAGCTGCAGCAGTCAGGTCCAGGACTG<br>GTGAAGCCCTCGCAGACCCTCTCACTCACCTGTG<br>CCATCTCCGGGGACAGTGTCTCTAGCAACAGTG<br>CTACTTGGAACTGGATCAGGCAGTCCCCATCGA<br>GAGGCCTTGAGTGGCTGGGAAGGACATACTACA<br>GGTCCAAGTGGTATAATGATTATGCAGTATCTGT<br>GAAAAGTCGAATAACCATCAACCCAGACACATC<br>CAAGAACCAGTTCTCCCTGCAGCTGAACTCTGT<br>GACTCCCGAGGACACGGCTGTGTATTACTGTGT<br>GGGTATTGTAGTAGTACCAGCTGTTCTCTTTGAC<br>TACTGGGGCCAGGGAACCCTGGTCACCGTCTCC<br>TCA |
| 58C2 | V_H85 | 583 | CAGGTGCAGCTGGTGGAGTCTGGGGGAGGCGTG<br>GTCCAGCCTGGGAGGTCCCTGAGACTCTCCTGT<br>GCAGCGTCTGGATTCACCTTCAGTAACTATGGC<br>ATGCACTGGGTCCGCCAGGCTCCAGGCAAGGGG<br>CTGGAGTGGGTGGCAGTTATATGGAATGATGGA<br>AATAACAAATACTATGCAGACTCCGTGAAGGGC<br>CGATTCACCATCTCCAGAGACAATTCCAAGAAC<br>ACGCTATATCTGCAAATGAACAGCCTGAGAGCC<br>GAGGACACGGCTGTGTATTACTGTGCGAGAGAT<br>CAGAATTACGATTTTTGGAATGGTTATCCCTACT<br>ACTTCTACTACGGTATGGACGTCTGGGGCCAAG<br>GGACCACGGTCACCGTCTCCTCA |
| 59A10<br>49H4 | V_H47 | 584 | CAGGTGCAGGTGGTGGAGTCTGGGGGAGGCTTG<br>GTCAAGCCTGGAGGGTCCCTGAGACTCTCCTGT<br>GCAGCCTCTGGATTCACCTTCAGTGACTCCTACA<br>TGAGCTGGATCCGCCAGGCTCCAGGGAAGGGGC<br>TGGAGTGGATTTCTTCCATTAGTAGTAGTGGTAG<br>TATCGTATACTTCGCAGACTCTGTGAAGGGCCG<br>ATTCACCATCTCCAGGGACATCGCCAAGAACTC<br>ACTGTATCTGCACATGAACAGCCTGAGAGCCGA<br>GGACACGGCCGTGTATTACTGTGCGAGAGAGAC<br>GTTTAGCAGTGGCTGGTTCGATGCTTTTGATATC<br>TGGGGCCAAGGGACAATGGTCACCGTCTCTTCA |
| 59C9<br>58A5<br>57A4<br>57F9 | V_H49 | 585 | GAGGTGCAGCTGGTGGAGTCTGGGGGAGGCCTG<br>GTCAAGCCTGGGGGGTCCCTGAGACTCTCCTGT<br>GCAGCCTCTGGATTCACCTTCAGTAGCTATAGCA<br>TGAGTTGGGTCCGCCAGGCTCCAGGGAAGGGGC<br>TGGAGTGGGTCTCATCCATTAGTAGTAGTAGTA<br>CTTACATATACTACGCAGACTCACTGAAGGGCC<br>GATTCACCATCTCCAGAGACAACGCCAAGAACT<br>CACTGTTTCTGCAAGTGAACAGCCTGAGAGCCG<br>AAGACTCGGCTGTGTATTACTGTGCGAGAGATC<br>GATGAGCAGTGGCTGGAACGAAGGTTTTGACT<br>ATTGGGGCCAGGGAACCCTGGTCACCGTCTCCT<br>CA |
| 59G10.2 | V_H57 | 586 | CAGGTGCAGCTGGTGGAGTCTGGGGGAGGCGTG<br>GTCCAGCCTGGGAGGTCCCTGAGACTCTCCTGT |

TABLE 2D-continued

Coding Sequence for Antibody Variable Heavy ($V_H$) Chains

| Contained in Clone | Designation | SEQ ID NO. | Coding Sequence |
|---|---|---|---|
| | | | GCAGCCTCTGGATTCACCTTCAGTAACTATGGCA<br>TGCACTGGGTCCGCCAGGCTCCAGGCAAGGGGC<br>TGGAGTGGGTGGCAATTACATCATATGGAGGAA<br>GTAATAAAAATTATGCAGACTCCGTGAAGGGCC<br>GATTCACCATCTCCAGAGACAATTCCAAGAACA<br>CGCTGTATCTGCAAATGAACAGCCTGAGAGCTG<br>AGGACACGGCTGTGTATTATTGTGCGAGAGAGG<br>CCGGGTATAGCTTTGACTACTGGGGCCAGGGAA<br>CCCTGGTCACCGTCTCCTCA |
| 59G10.3 | $V_H$53 | 587 | GAGGTGCAACTGTTGGGATCTGGGGGAGGCTTG<br>GTACAGCCTGGGGGGTCCCTGAGACTCTCCTGT<br>GCAGCCTCTGGATTCACCTTTAACCACTATGCCA<br>TGAGCTGGGTCCGCCAGGCTCCAGGGAAGGGGC<br>TGGAGTGGGTCTCAGCTATTAGTGGTAGTGGTG<br>CTGGCACATTCTACGCGGACTCCATGAAGGGCC<br>GGTTCACCATCTCCAGAGACAATTCCGAGAACA<br>CGCTGCATCTGCAGATGAACAGCCTGAGAGCCG<br>AGGACACGGCCATATATTACTGTGCGAAAGATC<br>TTAGAATAGCAGTGGCTGGTTCATTTGACTACTG<br>GGGCCAGGGAACCCTGGTCACCGTCTCCTCA |
| 60D7 | $V_H$66 | 588 | CAGGTGCAGCTGGTGGAGTCTGGGGGAGGCGTG<br>GTCCAGCCTGGGAGGTCCCTGAGACTCTCCTGT<br>GCAGCGTCTGGATTCAACTTCAGTAGCTATGGC<br>ATGCACTGGGTCCGCCAGGCTCCAGGCAAGGGG<br>CTGGAGTGGGTGGCAGTTATATGGTATGATGGA<br>AGTAATAAATACTATGCAGACTCCGTGAAGGGC<br>CGATTCACCATCTCCAGAGACAATTCCAAGAAC<br>ACGCTGTATCTGCAAATGAACAGCCTGAGAGCC<br>GAGGACACGGCTGTGTTTTACTGTGCGAGAGAT<br>CAGTATTTCGATTTTTGGAGTGGTTATCCTTTCTT<br>CTACTACTACGGTATGGACGTCTGGGGCCAAGG<br>GACCACGGTCACCGTCTCCTCA |
| 60F9<br>48B4<br>52D6 | $V_H$55 | 589 | GAGGTGCAGCTGTTGGAGTCTGGGGGAGGCTTG<br>GTACAGCCTGGGGGGTCCCTGAGACTCTCCTGT<br>GCAGCCTCTGGATTCACCTTTAGCAGCTATGCCA<br>TGAGTTGGGTCCGCCAGGCTCCAGGGAAGGGGC<br>TGGAGTGGGTCTCAGTTATTAGTGACAGTGGTG<br>GTAGCACATACTACGCAGACTCCGTGAAGGGCC<br>GGTTCACCATCTCCAGAGACAATTCCAAGAACA<br>CGCTGTATCTACAAATGAACAGCCTGAGAGCCG<br>AGGATACGGCCGTATATTACTGTGCGAAAGATC<br>ATAGCAGTGGCTGGTACTACTACGGTATGGACG<br>TCTGGGGCCAAGGGACCACGGTCACCGTCTCCT<br>CA |
| 60G5.2 | $V_H$45 | 590 | CAGGTTCAGCTGGTGCAGTCTGGAGCTGAGGTG<br>AAGACGCCCGGGGCCTCAGTGAGGGTCTCCTGC<br>AAGGCTTCTGGTTACACCTTTACCAACTATGGTA<br>TCAGCTGGGTGCGACAGGCCCCTGGACAAGGGC<br>TTGAGTGGATGGGATGGATCAGCGCTTACAATG<br>GTTACTCAAACTATGCACAGAAGTTCCAGGACA<br>GAGTCACCATGACCACAGACACATCCACGAGCA<br>CAGCCTACATGGAGCTGAGGAGCCTGAGATCTG<br>ACGACACGGCCGTGTATTACTGTGCGAGAGAGG<br>AGAAGCAGCTCGTCAAAGACTATTACTACTACG<br>GTATGGACGTCTGGGGCCAGGGGTCCACGGTCA<br>CCGTCTCCTCA |
| 61G5 | $V_H$56 | 591 | GAGGTGCAGCTGTTGGAGTCTGGGGGAGGCTTG<br>GTACAGCCTGGGGGGTCCCTGAGACTCTCCTGT<br>GCAGCCTCTGGATTCACCTTTAGCAGCTATGCCA<br>TGAGCTGGGTCCGCCAGTCTCCAGGGAAGGGGC<br>TGGAGTGGGTCTCAGTTATTAGTGGTAGTGGTG<br>GTGACACATACTACGCAGACTCCGTGAAGGGCC<br>GGTTCACCATCTCCAGAGACAATTCCAAGAACA<br>CGCTGTATCTACAAATGAACAGCCTGAGAGCCG<br>AGGATACGGCCGTATATTACTGTGCGAAAGATC<br>ATACCAGTGGCTGGTACTACTACGGTATGGACG<br>TCTGGGGCCAAGGGACCACGGTCACCGTCTCCT<br>CA |

TABLE 2D-continued

Coding Sequence for Antibody Variable Heavy (V_H) Chains

| Contained in Clone | Designation | SEQ ID NO. | Coding Sequence |
|---|---|---|---|
| 56G3.2 | V_H80 | 592 | CAGGTGCAGCTGCAGGAGTCGGGCCCAGGACTG GTGAAGCCTTCGGAGACCCTGTCCCTCACCTGC ACTGTCTCTGATGGCTCCATCAGTAGTTACTACT GGAACTGGATCCGGCAGCCCGCCGGGAAGGGA CTGGAGTGGATTGGGCGTATCTATACCAGTGGG AGCACCAACTACAATCCCTCCCTCAAGAGTCGA GTCACCATGTCAGTAGACACGTCCAAGAACCAG TTCTCCCTGAACCTGACCTCTGTGACCGCCGCGG ACACGGCCGTGTATTACTGTGCGAGAGGCCCTC TTTGGTTTGACTACTGGGGCCAGGGAACCCTGG TCACCGTCTCCTCA |
| 48G4 53C3.1 | V_H83 | 593 | CAGGTCCAGCTGGTACAGTCTGGGGCTGAGGTG AAGAAGCCTGGGGCCTCAGTGAAGGTCTCCTGC AAGGTTTCCGGATACACCCTCACTGAATTATCCA TACACTGGGTGCGACAGGCTCCTGGAAAAGGGC TTGAGTGGATGGGAGGTTTTGATCCTGAAGATG GTGAAACAATCTACGCACAGAAGTTCCAGGGCA GAGTCACCATGACCGAGGACACATCTACAGACA CAGCCTACATGGAGCTGAGCAGCCTGAGATCTG AGGACACGGCCGTGTATTACTGTGCAACACATT CTGGTTCGGGGAGGTTTTACTACTACTACTACGG TATGGACGTCTGGGGCCAAGGGACCACGGTCAC CGTCTCCTCA |
| 61H5 52B9 | V_H86 | 594 | CAGCTGCAGCTGCAGGAGTCGGGCCCAGGACTG GTGAAGCCTTCGGAGACCCTGTCCCTCACCTGC ACTGTCTCTGGTGGCTCCATCAGCAGTAGTAGTT ACTACTGGGGCTGGATCCGCCAGCCCCCAGGGA AGGGGCTGGAGTGGATTGGGAGTATCTATTATA GTGGGACCACCTACTACAACCCGTCCCTCAAGA GTCGAGTCACCATATCCGTAGACACGTCCAAGA ACCAGTTCTCCCTGAAGCTGAGTTCTGTGACCGC CGCAGACACGGCTGTGTATTACTGTGCGAGAGT GGCAGCAGTTTACTGGTACTTCGATCTCTGGGGC CGTGGCACCCTGGTCACTGTCTCCTCA |
| 50D4 | V_H87 | 595 | CAGGTGCAGCTGGTGCAGTCTGGGGCTGAGGTG AAGAAGACTGGGGCCTCAGTGAAGGTCTCCTGC AAGGCTTCTGGATACACCTTCACCAGTCATGAT ATCAACTGGGTGCGACAGGCCACTGGACACGGG CTTGAGTGGATGGGATGGATGAACCCTTACAGT GGTAGCACAGGCCTCGCACAGAGGTTCCAGGAC AGAGTCACCATGACCAGGAACACCTCCATAAGC ACAGCCTACATGGAGCTGAGCAGCCTGAGATCT GAGGACACGGCCGTGTATTACTGTGCGAGAGAC CTTAGCAGTGGCTACTACTACTACGGTTTGGACG TGTGGGGCCAAGGGACCACGGTCACCGTCTCCT CA |
| 50G5v1 50G5v2 | V_H88 | 596 | CAGGTGCAGCTGGTGCAGTCTGGGGCTGAGGTG AAGAAGCCTGGGGCCTCAGTGAAGGTCTCCTGC AAGGCCTCTGGATACCCCTTCATCGGCTACTATA TGCACTGGGTGCGACAGGCCCCTGGACAAGGGC TTGAGTGGATGGGATGGATCAACCCTGACAGTG GTGGCACAAACTATGCACAGAAGTTTCAGGGCA GGGTCACCATGACCAGGGACACGTCCATCACCA CAGCCTACATGGAGCTGAGCAGGCTGAGATCTG ACGACACGGCCGTTTTTTACTGTGCGAGAGGCG GATACAGCTATGGTTACGAGGACTACTACGGTA TGGACGTCTGGGGCCAAGGGACCACGGTCACCG TCTCCTCA |
| 51C1 | V_H89 | 597 | CAGGTGCAGCTACAGCAGTGGGGCGCAGGACTG TTGAAGCCTTCGGAGACCCTGTCCCTCACTTGCG CTGTCTATGGTGGGTCCTTCAGTGGTTACTACTG GAGCTGGATCCGCCAGCCCCCAGGGAAGGGTCT GGAGTGGATTGGGGAAATCAATCATAGTGAAAA CACCAACTACAACCCGTCCCTCAAGAGTCGAGT CACCATATCACTAGACACGTCCATGACCAGTT CTCCCTAAGACTAACCTCTGTGACCGCCGCGGA CACGGCTGTCTATTACTGTGCGAGAGTAACTGG AACGGATGCTTTTGATTTCTGGGGCCAAGGGAC AATGGTCACCGTCTCTTCA |

TABLE 2D-continued

Coding Sequence for Antibody Variable Heavy ($V_H$) Chains

| Contained in Clone | Designation | SEQ ID NO. | Coding Sequence |
|---|---|---|---|
| 53C3.2 | $V_H$90 | 598 | CAGGTGCAGCTGCAGGAGTCGGGCCCAGGACTG GTGAAGCCTTCACAGACCCTGTCCCTCACCTGCA CTGTCTCTAATGGCTCCATCAATAGTGGTAATTA CTACTGGAGCTGGATCCGCCAGCACCCAGGAAA GGGCCTGGAGTGGATTGGGTACATCTATCACAG TGGGAGCGCCTACTACAACCCGTCCCTCAAGAG TCGAGTTACCATATCAGTGGACACGTCTAAGAA CCAGTTCTCCCTAAAGCTGAGTTCTGTGACTGCC GCGGACACGGCCGTGTATTACTGTGCGAGAACT ACGGGTGCTTCTGATATCTGGGGCCAAGGGATA ATGGTCACCGTCTCTTCA |
| 54H10.3 | $V_H$91 | 599 | CAGGTGCAGGTAGTGCAGTCTGGGACTGAGGTG AAGAAGCCTGGGGCCTCAGTGAAGGTCTCCTGC AAGGCTTCTGGATACACCTTCACAGGCTACTAT ATACATTGGGTGCGACAGGCCCCTGGACAAGGG CTTGAGTGGATGGGATGGATCAACCCTAACAGT GGTGGCACAAACTATGCACAGAAGTTTCGGGGC AGGGTCACCATGACCAGGGACACGTCCATCAGC ACAGCCTACATGGAGCTGAGCAGGCTGAGATCT GACGACACGGCCGTGTATTACTGTGCGAGAGAG GAAGACTACAGTGACCACCACTACTTTGACTAC TGGGGCCAGGGAACCCTGGTCACCGTCTCCTCA |
| 55A7 | $V_H$92 | 600 | CAGGTGCAGCTGCAGGAGTCGGGCCCAGGACTG GTGAAGCCTTCGGAGACCCTGTCCCTCACCTGC ACTGTCTCTGGTGGCTCCATCAGTAGTTACTACT GGAGCTGGATCCGGCAGCCCCCAGGGAAGGGA CTGGAGTGGATTGGGTATATCTATTACAGTGGG AGCACCAACTACAACCCCTCCCTCAAGAGTCGA GTCACCATATCAGTAGACACGTCCAAGAACCAG TTCTCCCTGAGGCTGAGCTCTGTGACCGCTGCGG ACACGGCCGTGTATTACTGTGCGAGAGGGATAA CTGGAACTATTGACTTCTGGGGCCAGGGAACCC TGGTCACCGTCTCCTCA |
| 55E6 | $V_H$93 | 601 | GAAGTGCAGTTGGTGGAGTCTGGGGGAGGCTTG GTACAGCCTGGGGGGTCCCTGAGACTCTCCTGT GCAGCCTCTGGATTCACCTTCAGTAGCTATAGCA TGAACTGGGTCCGCCAGGCTCCAGGGAAGGGGC TGGAGTGGATTTCATACATTAGTAGTGGTAGTA GTACCATATACCACGCAGACTCTGTGAAGGGCC GATTCACCATTTCCAGAGACAATGCCAAGAACT CACTGTATCTGCAAATGAACAGCCTGAGAGACG AGGACACGGCTGTGTATTACTGTGCGAGAGAAG GGTACTATGATAGTAGTGGTTATTACTACAACG GTATGGACGTCTGGGGCCAAGGGACCACGGTCA CCGTCTCCTCA |
| 61E1 | $V_H$94 | 602 | CAGGTACAGCTACAGCAGTCAGGTCCAGGACTG GTGAAGCCCTCGCAGACCCTCTCACTCACCTGTG CCATCTCCGGGGACAGTGTCTCTAGCAACAGTG CTGCTTGGAACTGGATCAGGCAGTCCCCATCGA GAGGCCTTGAGTGGCTGGGAAGGACATACTACA GGTCCAAGTGGTATAATGATTATGCAGTATCTGT GAAAAGTCGAATAACCATCACCCCAGACACATC CAAGAACCAGTTCTCCCTGCAGCTGAAGTCTGT GACTCCCGAGGACACGGCTATTTATTACTGTGC AAGAGAGGGCAGCTGGTCCTCCTTCTTTGACTA CTGGGGCCAGGGAACCCTGGTCACCGTTTCCTCA |

Each of the heavy chain variable regions listed in Table 2B can be combined with any of the light chain variable regions shown in Table 2A to form an antigen binding protein. Examples of such combinations include $V_H1$ combined with any of $V_L1$, $V_L2$, $V_L3$, $V_L4$, $V_L5$, $V_L6$, $V_L7$, $V_L8$, $V_L9$, $V_L10$, $V_L11$, $V_L12$, $V_L13$, $V_L14$, $V_L15$, $V_L16$, $V_L17$, $V_L18$, $V_L19$, $V_L20$, $V_L21$, $V_L22$, $V_L23$, $V_L24$, $V_L25$, $V_L26$, $V_L27$, $V_L28$, $V_L29$, $V_L30$, $V_L31$, $V_L32$, $V_L33$, $V_L34$, $V_L35$, $V_L36$, $V_L37$, $V_L38$, $V_L39$, $V_L40$, $V_L41$, $V_L42$, $V_L43$, $V_L44$, $V_L45$, $V_L46$, $V_L47$, $V_L48$, $V_L49$, $V_L50$, $V_L51$, $V_L52$, $V_L53$, $V_L54$, $V_L55$, $V_L56$, $V_L57$, $V_L58$, $V_L59$, $V_L60$, $V_L61$, $V_L62$, $V_L63$, $V_L64$, $V_L65$, $V_L66$, $V_L67$, $V_L68$, $V_L69$, $V_L70$, $V_L71$, $V_L72$, $V_L73$, $V_L74$, $V_L75$, $V_L76$, $V_L77$, $V_L78$, $V_L79$, $V_L80$, $V_L81$, $V_L82$, $V_L83$, $V_L84$, $V_L85$, $V_L86$, $V_L87$, $V_L88$, $V_L89$, $V_L90$, $V_L91$, $V_L92$, $V_L93$, $V_L94$, $V_L95$, $V_L96$, $V_L97$, $V_L98$, $V_L99$ and $V_L100$; $V_H2$ combined with any of $V_L1$, $V_L2$, $V_L3$, $V_L4$, $V_L5$, $V_L6$, $V_L7$, $V_L8$, $V_L9$, $V_L10$, $V_L11$, $V_L12$, $V_L13$, $V_L14$, $V_L15$, $V_L16$, $V_L17$, $V_L18$, $V_L19$, $V_L20$, $V_L21$, $V_L22$, $V_L23$, $V_L24$, $V_L25$, $V_L26$, $V_L27$, $V_L28$, $V_L29$, $V_L30$, $V_L31$, $V_L32$, $V_L33$, $V_L34$, $V_L35$, $V_L36$, $V_L37$, $V_L38$, $V_L39$, $V_L40$, $V_L41$, $V_L42$, $V_L43$, $V_L44$, $V_L45$, $V_L46$, $V_L47$, $V_L48$, $V_L49$, $V_L50$, $V_L51$, $V_L52$, $V_L53$, $V_L54$, $V_L55$, $V_L56$, $V_L57$, $V_L58$, $V_L59$, $V_L60$, $V_L61$, $V_L62$, $V_L63$, $V_L64$, $V_L65$, $V_L66$, $V_L67$, $V_L68$, $V_L69$, $V_L70$, $V_L71$, $V_L72$, $V_L73$, $V_L74$, $V_L75$, $V_L76$, $V_L77$, $V_L78$, $V_L79$, $V_L80$, $V_L81$, $V_L82$, $V_L83$, $V_L84$, $V_L85$, $V_L86$, $V_L87$, $V_L88$, $V_L89$, $V_L90$, $V_L91$, $V_L92$, $V_L93$, $V_L94$, $V_L95$, $V_L96$, $V_L97$, $V_L98$, $V_L99$ and $V_L100$; $V_H3$ combined with any of $V_L1$, $V_L2$, $V_L3$, $V_L4$, $V_L5$, $V_L6$, $V_L7$, $V_L8$, $V_L9$, $V_L10$, $V_L11$, $V_L12$, $V_L13$, $V_L14$, $V_L15$, $V_L16$, $V_L17$, $V_L18$, $V_L19$, $V_L20$, $V_L21$, $V_L22$, $V_L23$, $V_L24$, $V_L25$, $V_L26$, $V_L27$, $V_L28$, $V_L29$, $V_L30$, $V_L31$, $V_L32$, $V_L33$, $V_L34$, $V_L35$, $V_L36$, $V_L37$, $V_L38$, $V_L39$, $V_L40$, $V_L41$, $V_L42$, $V_L43$, $V_L44$, $V_L45$, $V_L46$, $V_L47$, $V_L48$, $V_L49$, $V_L50$, $V_L51$, $V_L52$, $V_L53$, $V_L54$, $V_L55$, $V_L56$, $V_L57$, $V_L58$, $V_L59$, $V_L60$, $V_L61$, $V_L62$, $V_L63$, $V_L64$, $V_L65$, $V_L66$, $V_L67$, $V_L68$, $V_L69$, $V_L70$, $V_L71$, $V_L72$, $V_L73$, $V_L74$, $V_L75$, $V_L76$, $V_L77$, $V_L78$, $V_L79$, $V_L80$, $V_L81$, $V_L82$, $V_L83$, $V_L84$, $V_L85$, $V_L86$, $V_L87$, $V_L88$, $V_L89$, $V_L90$, $V_L91$, $V_L92$, $V_L93$, $V_L94$, $V_L95$, $V_L96$, $V_L97$, $V_L98$, $V_L99$ and $V_L100$; and so on.

In some instances, the antigen binding protein includes at least one heavy chain variable region and/or one light chain variable region from those listed in Tables 2A and 2B. In some instances, the antigen binding protein includes at least two different heavy chain variable regions and/or light chain variable regions from those listed in Table 2B. An example of such an antigen binding protein comprises (a) one $V_H1$, and (b) one of $V_H2$, $V_H3$, $V_H4$, $V_H5$, $V_H6$, $V_H7$, $V_H8$, $V_H9$, $V_H10$, $V_H11$, $V_H12$, $V_H13$, $V_H14$, $V_H15$, $V_H16$, $V_H17$, $V_H18$, $V_H19$, $V_H20$, $V_H21$ $V_H22$, $V_H23$, $V_H24$, $V_H25$, $V_H26$, $V_H27$, $V_H28$, $V_H29$, $V_H30$, $V_H31$, $V_H32$, $V_H33$, $V_H34$, $V_H35$, $V_H36$, $V_H37$, $V_H38$, $V_H39$, $V_H40$, $V_H41$, $V_H42$, $V_H43$, $V_H44$, $V_H45$, $V_H46$, $V_H47$, $V_H48$, $V_H49$, $V_H50$, $V_H51$, $V_H52$, $V_H53$, $V_H54$, $V_H55$, $V_H56$, $V_H57$, $V_H58$, $V_H59$, $V_H60$, $V_H61$, $V_H62$, $V_H63$, $V_H64$, $V_H65$, $V_H66$, $V_H67$, $V_H68$, $V_H69$, $V_H70$, $V_H71$, $V_H72$, $V_H73$, $V_H74$, $V_H75$, $V_H76$, $V_H77$, $V_H78$, $V_H79$, $V_H80$, 81, $V_H82$, $V_H83$, $V_H84$, $V_H85$, $V_H$ 86, $V_H$ 87, $V_H88$, $V_H89$, $V_H90$, $V_H91$, $V_H92$, $V_H93$, and $V_H94$. Another example comprises (a) one $V_H2$, and (b) one of $V_H1$, $V_H3$, $V_H4$, $V_H5$, $V_H6$, $V_H7$, $V_H8$, $V_H9$, $V_H10$, $V_H11$, $V_H12$, $V_H13$, $V_H14$, $V_H15$, $V_H16$, $V_H17$, $V_H18$, $V_H19$, $V_H20$, $V_H21$ $V_H22$, $V_H23$, $V_H24$, $V_H25$, $V_H26$, $V_H27$, $V_H28$, $V_H29$, $V_H30$, $V_H31$, $V_H32$, $V_H33$, $V_H34$, $V_H35$, $V_H36$, $V_H37$, $V_H38$, $V_H39$, $V_H40$, $V_H41$, $V_H42$, $V_H43$, $V_H44$, $V_H45$, $V_H46$, $V_H47$, $V_H48$, $V_H49$, $V_H50$, $V_H51$, $V_H52$, $V_H53$, $V_H54$, $V_H55$, $V_H56$, $V_H57$, $V_H58$, $V_H59$, $V_H60$, $V_H61$, $V_H62$, $V_H63$, $V_H64$, $V_H65$, $V_H66$, $V_H67$, $V_H68$, $V_H69$, $V_H70$, $V_H71$, $V_H72$, $V_H73$, $V_H74$, $V_H75$, $V_H76$, $V_H77$, $V_H78$, $V_H79$, $V_H80$, 81, $V_H82$, $V_H83$, $V_H84$, $V_H85$, $V_H$ 86, $V_H$ 87, $V_H88$, $V_H89$, $V_H90$, $V_H91$, $V_H92$, $V_H93$, and $V_H94$. Yet another example comprises (a) one $V_H3$, and (b) one of $V_H1$, $V_H2$, $V_H4$, $V_H5$, $V_H6$, $V_H7$, $V_H8$, $V_H9$, $V_H10$, $V_H11$, $V_H12$, $V_H13$, $V_H14$, $V_H15$, $V_H16$, $V_H17$, $V_H18$, $V_H19$, $V_H20$, $V_H21$ $V_H22$, $V_H23$, $V_H24$, $V_H25$, $V_H26$, $V_H27$, $V_H28$, $V_H29$, $V_H30$, $V_H31$, $V_H32$, $V_H33$, $V_H34$, $V_H35$, $V_H36$, $V_H37$, $V_H38$, $V_H39$, $V_H40$, $V_H41$, $V_H42$, $V_H43$, $V_H44$, $V_H45$, $V_H46$, $V_H47$, $V_H48$, $V_H49$, $V_H50$, $V_H51$, $V_H52$, $V_H53$, $V_H54$, $V_H55$, $V_H56$, $V_H57$, $V_H58$, $V_H59$, $V_H60$, $V_H61$, $V_H62$, $V_H63$, $V_H64$, $V_H65$, $V_H66$, $V_H67$, $V_H68$, $V_H69$, $V_H70$, $V_H71$, $V_H72$, $V_H73$, $V_H74$, $V_H75$, $V_H76$, $V_H77$, $V_H78$, $V_H79$, $V_H80$, 81, $V_H82$, $V_H83$, $V_H84$, $V_H85$, $V_H$ 86, $V_H$ 87, $V_H88$, $V_H89$, $V_H90$, $V_H91$, $V_H92$, $V_H93$, and $V_H94$, etc. Still another example of such an antigen binding protein comprises (a) one $V_L1$, and (b) one of $V_L2$, $V_L3$, $V_L4$, $V_L5$, $V_L6$, $V_L7$, $V_L8$, $V_L9$, $V_L10$, $V_L11$, $V_L12$, $V_L13$, $V_L14$, $V_L15$, $V_L16$, $V_L17$, $V_L18$, $V_L19$, $V_L20$, $V_L21$, $V_L22$, $V_L23$, $V_L24$, $V_L25$, $V_L26$, $V_L27$, $V_L28$, $V_L29$, $V_L30$, $V_L31$, $V_L32$, $V_L33$, $V_L34$, $V_L35$, $V_L36$, $V_L37$, $V_L38$, $V_L39$, $V_L40$, $V_L41$, $V_L42$, $V_L43$, $V_L44$, $V_L45$, $V_L46$, $V_L47$, $V_L48$, $V_L49$, $V_L50$, $V_L51$, $V_L52$, $V_L53$, $V_L54$, $V_L55$, $V_L56$, $V_L57$, $V_L58$, $V_L59$, $V_L60$, $V_L61$, $V_L62$, $V_L63$, $V_L64$, $V_L65$, $V_L66$, $V_L67$, $V_L68$, $V_L69$, $V_L70$, $V_L71$, $V_L72$, $V_L73$, $V_L74$, $V_L75$, $V_L76$, $V_L77$, $V_L78$, $V_L79$, $V_L80$, $V_L81$, $V_L82$, $V_L83$, $V_L84$, $V_L85$, $V_L86$, $V_L87$, $V_L88$, $V_L89$, $V_L90$, $V_L91$, $V_L92$, $V_L93$, $V_L94$, $V_L95$, $V_L96$, $V_L97$, $V_L98$, $V_L99$ and $V_L100$. Again another example of such an antigen binding protein comprises (a) one $V_L2$, and (b) one of $V_L1$, $V_L3$, $V_L4$, $V_L5$, $V_L6$, $V_L7$, $V_L8$, $V_L9$, $V_L10$, $V_L11$, $V_L12$, $V_L13$, $V_L14$, $V_L15$, $V_L16$, $V_L17$, $V_L18$, $V_L19$, $V_L20$, $V_L21$, $V_L22$, $V_L23$, $V_L24$, $V_L25$, $V_L26$, $V_L27$, $V_L28$, $V_L29$, $V_L30$, $V_L31$, $V_L32$, $V_L33$, $V_L34$, $V_L35$, $V_L36$, $V_L37$, $V_L38$, $V_L39$, $V_L40$, $V_L41$, $V_L42$, $V_L43$, $V_L44$, $V_L45$, $V_L46$, $V_L47$, $V_L48$, $V_L49$, $V_L50$, $V_L51$, $V_L52$, $V_L53$, $V_L54$, $V_L55$, $V_L56$, $V_L57$, $V_L58$, $V_L59$, $V_L60$, $V_L61$, $V_L62$, $V_L63$, $V_L64$, $V_L65$, $V_L66$, $V_L67$, $V_L68$, $V_L69$, $V_L70$, $V_L71$, $V_L72$, $V_L73$, $V_L74$, $V_L75$, $V_L76$, $V_L77$, $V_L78$, $V_L79$, $V_L80$, $V_L81$, $V_L82$, $V_L83$, $V_L84$, $V_L85$, $V_L86$, $V_L87$, $V_L88$, $V_L89$, $V_L90$, $V_L91$, $V_L92$, $V_L93$, $V_L94$, $V_L95$, $V_L96$, $V_L97$, $V_L98$, $V_L99$ and $V_L100$. Again another example of such an antigen binding protein comprises (a) one $V_L3$, and (b) one of $V_L1$, $V_L2$, $V_L4$, $V_L5$, $V_L6$, $V_L7$, $V_L8$, $V_L9$, $V_L10$, $V_L11$, $V_L12$, $V_L13$, $V_L14$, $V_L15$, $V_L16$, $V_L17$, $V_L18$, $V_L19$, $V_L20$, $V_L21$, $V_L22$, $V_L23$, $V_L24$, $V_L25$, $V_L26$, $V_L27$, $V_L28$, $V_L29$, $V_L30$, $V_L31$, $V_L32$, $V_L33$, $V_L34$, $V_L35$, $V_L36$, $V_L37$, $V_L38$, $V_L39$, $V_L40$, $V_L41$, $V_L42$, $V_L43$, $V_L44$, $V_L45$, $V_L46$, $V_L47$, $V_L48$, $V_L49$, $V_L50$, $V_L51$, $V_L52$, $V_L53$, $V_L54$, $V_L55$, $V_L56$, $V_L57$, $V_L58$, $V_L59$, $V_L60$, $V_L61$, $V_L62$, $V_L63$, $V_L64$, $V_L65$, $V_L66$, $V_L67$, $V_L68$, $V_L69$, $V_L70$, $V_L71$, $V_L72$, $V_L73$, $V_L74$, $V_L75$, $V_L76$, $V_L77$, $V_L78$, $V_L79$, $V_L80$, $V_L81$, $V_L82$, $V_L83$, $V_L84$, $V_L85$, $V_L86$, $V_L87$, $V_L88$, $V_L89$, $V_L90$, $V_L91$, $V_L92$, $V_L93$, $V_L94$, $V_L95$, $V_L96$, $V_L97$, $V_L98$, $V_L99$ and $V_L100$, etc.

The various combinations of heavy chain variable regions can be combined with any of the various combinations of light chain variable regions.

In other embodiments, an antigen binding protein comprises two identical light chain variable regions and/or two identical heavy chain variable regions. As an example, the antigen binding protein can be an antibody or immunologically functional fragment thereof that includes two light chain variable regions and two heavy chain variable regions in combinations of pairs of light chain variable regions and pairs of heavy chain variable regions as listed in Tables 2A and 2B.

Some antigen binding proteins that are provided comprise a heavy chain variable domain comprising a sequence of amino acids that differs from the sequence of a heavy chain variable domain selected from $V_H1$, $V_H2$, $V_H3$, $V_H4$, $V_H5$, $V_H6$, $V_H7$, $V_H8$, $V_H9$, $V_H10$, $V_H11$, $V_H12$, $V_H13$, $V_H14$, $V_H15$, $V_H16$, $V_H17$, $V_H18$, $V_H19$, $V_H20$, $V_H21$ $V_H22$, $V_H23$, $V_H24$, $V_H25$, $V_H26$, $V_H27$, $V_H28$, $V_H29$, $V_H30$, $V_H31$, $V_H32$, $V_H33$, $V_H34$, $V_H35$, $V_H36$, $V_H37$, $V_H38$, $V_H39$, $V_H40$, $V_H41$, $V_H42$, $V_H43$, $V_H44$, $V_H45$, $V_H46$, $V_H47$, $V_H48$, $V_H49$, $V_H50$, $V_H51$, $V_H52$, $V_H53$, $V_H54$, $V_H55$, $V_H56$, $V_H57$, $V_H58$, $V_H59$, $V_H60$, $V_H61$, $V_H62$, $V_H63$, $V_H64$, $V_H65$, $V_H66$, $V_H67$, $V_H68$, $V_H69$, $V_H70$, $V_H71$, $V_H72$, $V_H73$, $V_H74$, $V_H75$, $V_H76$, $V_H77$, $V_H78$, $V_H79$, $V_H80$, 81, $V_H82$, $V_H83$, $V_H84$, $V_H85$, $V_H$ 86, $V_H$ 87, $V_H88$, $V_H89$, $V_H90$, $V_H91$, $V_H92$, $V_H93$, and $V_H94$ at only 1, 2, 3, 4, 5, 6, 7, 8, 9, 10, 11, 12, 13, 14 or 15 amino acid residues, wherein each such sequence difference is independently either a deletion, insertion or substitution of one amino acid, with the deletions, insertions and/or substitutions resulting in no more than 15 amino acid changes relative to the foregoing variable domain sequences. The heavy chain variable region in some antigen binding proteins comprises a sequence of amino acids that has at least 70%, 75%, 80%, 85%, 90%, 95%, 97% or 99% sequence identity to the amino acid sequences of the heavy chain variable region of $V_H1$, $V_H2$, $V_H3$, $V_H4$, $V_H5$, $V_H6$, $V_H7$, $V_H8$, $V_H9$, $V_H10$, $V_H11$, $V_H12$, $V_H13$, $V_H14$, $V_H15$, $V_H16$, $V_H17$, $V_H18$, $V_H19$, $V_H20$, $V_H21$ $V_H22$, $V_H23$, $V_H24$, $V_H25$, $V_H26$, $V_H27$, $V_H28$, $V_H29$, $V_H30$, $V_H31$, $V_H32$, $V_H33$, $V_H34$, $V_H35$, $V_H36$, $V_H37$, $V_H38$, $V_H39$, $V_H40$, $V_H41$, $V_H42$, $V_H43$, $V_H44$, $V_H45$, $V_H46$, $V_H47$, $V_H48$, $V_H49$, $V_H50$, $V_H51$, $V_H52$, $V_H53$, $V_H54$, $V_H55$, $V_H56$, $V_H57$, $V_H58$, $V_H59$, $V_H60$, $V_H61$, $V_H62$, $V_H63$, $V_H64$, $V_H65$, $V_H66$, $V_H67$, $V_H68$, $V_H69$, $V_H70$, $V_H71$, $V_H72$, $V_H73$, $V_H74$, $V_H75$, $V_H76$, $V_H77$, $V_H78$, $V_H79$, $V_H80$, 81, $V_H82$, $V_H83$, $V_H84$, $V_H85$, $V_H$ 86, $V_H$ 87, $V_H88$, $V_H89$, $V_H90$, $V_H91$, $V_H92$, $V_H93$, and $V_H94$.

Certain antigen binding proteins comprise a light chain variable domain comprising a sequence of amino acids that differs from the sequence of a light chain variable domain selected from $V_L1$, $V_L2$, $V_L3$, $V_L4$, $V_L5$, $V_L6$, $V_L7$, $V_L8$, $V_L9$, $V_L10$, $V_L11$, $V_L12$, $V_L13$, $V_L14$, $V_L15$, $V_L16$, $V_L17$, $V_L18$, $V_L19$, $V_L20$, $V_L21$, $V_L22$, $V_L23$, $V_L24$, $V_L25$, $V_L26$, $V_L27$, $V_L28$, $V_L29$, $V_L30$, $V_L31$, $V_L32$, $V_L33$, $V_L34$, $V_L35$, $V_L36$, $V_L37$, $V_L38$, $V_L39$, $V_L40$, $V_L41$, $V_L42$, $V_L43$, $V_L44$, $V_L45$, $V_L46$, $V_L47$, $V_L48$, $V_L49$, $V_L50$, $V_L51$, $V_L52$, $V_L53$, $V_L54$, $V_L55$, $V_L56$, $V_L57$, $V_L58$, $V_L59$, $V_L60$, $V_L61$, $V_L62$, $V_L63$, $V_L64$, $V_L65$, $V_L66$, $V_L67$, $V_L68$, $V_L69$, $V_L70$, $V_L71$, $V_L72$, $V_L73$, $V_L74$, $V_L75$, $V_L76$, $V_L77$, $V_L78$, $V_L79$, $V_L80$, $V_L81$, $V_L82$, $V_L83$, $V_L84$, $V_L85$, $V_L86$, $V_L87$, $V_L88$, $V_L89$, $V_L90$, $V_L91$, $V_L92$, $V_L93$, $V_L94$, $V_L95$, $V_L96$, $V_L97$, $V_L98$, $V_L99$ and $V_L100$ at only 1, 2, 3, 4, 5, 6, 7, 8, 9, 10, 11, 12, 13, 14 or 15 amino acid residues, wherein each such sequence difference is independently either a deletion, insertion or substitution of one amino acid, with the deletions, insertions and/or substitutions resulting in no more than 15 amino acid changes relative to the foregoing variable domain sequences. The light chain variable region in some antigen binding proteins comprises a sequence of amino acids that has at least 70%, 75%, 80%, 85%, 90%, 95%, 97% or 99% sequence identity to the amino acid sequences of the light chain variable region of $V_L1$, $V_L2$, $V_L3$, $V_L4$, $V_L5$, $V_L6$, $V_L7$, $V_L8$, $V_L9$, $V_L10$, $V_L11$, $V_L12$, $V_L13$, $V_L14$, $V_L15$, $V_L16$, $V_L17$, $V_L18$, $V_L19$, $V_L20$, $V_L21$, $V_L22$, $V_L23$, $V_L24$, $V_L25$, $V_L26$, $V_L27$, $V_L28$, $V_L29$, $V_L30$, $V_L31$, $V_L32$, $V_L33$, $V_L34$, $V_L35$, $V_L36$, $V_L37$, $V_L38$, $V_L39$, $V_L40$, $V_L41$, $V_L42$, $V_L43$, $V_L44$, $V_L45$, $V_L46$, $V_L47$, $V_L48$, $V_L49$, $V_L50$, $V_L51$, $V_L52$, $V_L53$, $V_L54$, $V_L55$, $V_L56$, $V_L57$, $V_L58$, $V_L59$, $V_L60$, $V_L61$, $V_L62$, $V_L63$, $V_L64$, $V_L65$, $V_L66$, $V_L67$, $V_L68$, $V_L69$, $V_L70$, $V_L71$, $V_L72$, $V_L73$, $V_L74$, $V_L75$, $V_L76$, $V_L77$, $V_L78$, $V_L79$, $V_L80$, $V_L81$, $V_L82$, $V_L83$, $V_L84$, $V_L85$, $V_L86$, $V_L87$, $V_L88$, $V_L89$, $V_L90$, $V_L91$, $V_L92$, $V_L93$, $V_L94$, $V_L95$, $V_L96$, $V_L97$, $V_L98$, $V_L99$ and $V_L100$.

In additional instances, antigen binding proteins comprise the following pairings of light chain and heavy chain variable domains: $V_L1$ with $V_H1$, $V_L2$ with $V_H1$, $V_L3$ with $V_H2$ or $V_H3$, $V_L4$ with $V_H4$, $V_L5$ with $V_H5$, $V_L6$ with $V_H6$, $V_L7$ with $V_H6$, $V_L8$ with $V_H7$ or $V_H8$, $V_L9$ with $V_H9$, $V_L10$ with $V_H9$, $V_L11$ with $V_H$ 10, $V_L12$ with $V_H11$, $V_L13$ with $V_H12$, $V_L13$ with $V_H14$, $V_L14$ with $V_H13$, $V_L15$ with $V_H14$, $V_L16$ with $V_H15$, $V_L17$ with $V_H16$, $V_L18$ with $V_H17$, $V_L19$ with $V_H18$, $V_L20$ with $V_H19$, $V_L21$ with $V_H20$, $V_L22$ with $V_H21$, $V_L23$ with $V_H22$, $V_L24$ with $V_H23$, $V_L25$ with $V_H24$, $V_L26$ with $V_H25$, $V_L27$ with $V_H26$, $V_L28$ with $V_H27$, $V_L29$ with $V_H28$, $V_L30$ with $V_H29$, $V_L31$ with $V_H30$, $V_L32$ with $V_H31$, $V_L33$ with $V_H32$, $V_L34$ with $V_H33$, $V_L35$ with $V_H34$, $V_L36$ with $V_H35$, $V_L37$ with $V_H36$, $V_L38$ with $V_H37$, $V_L39$ with $V_H38$, $V_L40$ with $V_H39$, $V_L41$ with $V_H40$, $V_L42$ with $V_H41$, $V_L43$ with $V_H42$, $V_L44$ with $V_H43$, $V_L45$ with $V_H44$, $V_L46$ with $V_H45$, $V_L47$ with $V_H46$, $V_L48$ with $V_H47$, $V_L49$ with $V_H48$, $V_L50$ with $V_H49$, $V_L51$ with $V_H50$, 52 with $V_H51$, $V_L53$ with $V_H52$, $V_L54$ with $V_H53$, $V_L55$ with 54, and $V_L56$ with $V_H54$, $V_L57$ with $V_H54$, $V_L58$ with $V_H55$, $V_L59$ with $V_H56$, $V_L60$ with $V_H57$, $V_L61$ with $V_H58$, $V_L62$ with $V_H59$, $V_L63$ with $V_H60$, $V_L64$ with $V_H1$, $V_L65$ with $V_H62$, $V_L66$ with $V_H63$, $V_L67$ with $V_H64$, $V_L68$ with $V_H65$, $V_L69$ with $V_H66$, $V_L70$ with $V_H67$, $V_L71$ with $V_H68$, $V_L72$ with $V_H69$, $V_L73$ with $V_H70$, $V_L74$ with $V_H70$, and $V_L75$ with $V_H70$, $V_L76$ with $V_H71$, $V_L77$ with $V_H72$, $V_L78$ with $V_H73$, $V_L79$ with $V_H74$, $V_L80$ with $V_H75$, $V_L81$ with $V_H76$, $V_L82$ with $V_H77$, $V_L83$ with $V_H78$, $V_L84$ with $V_H79$, $V_L85$ with $V_H80$, $V_L86$ with $V_H81$, $V_L87$ with $V_H82$, $V_L88$ with $V_H86$, $V_L89$ with $V_H83$, $V_L90$ with $V_H84$, $V_L91$ with $V_H85$, $V_L$ 92 with $V_H$ 87, $V_L$ 93 with $V_H$ 88, $V_L$ 94 with $V_H$ 88, $V_L$ 95 with $V_H$ 89, $V_L$ 96 with $V_H$ 90, $V_L$ 97 with $V_H$ 91, $V_L$ 98 with $V_H$ 92, $V_L$ 99 with $V_H$ 93, and $V_L$ 100 with $V_H$ 94.

In some instances, the antigen binding proteins in the above pairings can comprise amino acid sequences that have 70%, 75%, 80%, 85%, 90%, 95%, 96%, 97%, 98% or 99% sequence identity with the specified variable domains.

Still other antigen binding proteins, e.g., antibodies or immunologically functional fragments, include variant forms of a variant heavy chain and a variant light chain as just described.

Antigen Binding Protein CDRs

In various embodiments, the antigen binding proteins disclosed herein can comprise polypeptides into which one or more CDRs are grafted, inserted and/or joined. An antigen binding protein can have 1, 2, 3, 4, 5 or 6 CDRs. An antigen binding protein thus can have, for example, one heavy chain CDR1 ("CDRH1"), and/or one heavy chain CDR2 ("CDRH2"), and/or one heavy chain CDR3 ("CDRH3"), and/or one light chain CDR1 ("CDRL1"), and/or one light chain CDR2 ("CDRL2"), and/or one light chain CDR3 ("CDRL3"). Some antigen binding proteins include both a CDRH3 and a CDRL3. Specific heavy and light chain CDRs are identified in Tables 3A and 3B, respectively, infra.

Complementarity determining regions (CDRs) and framework regions (FR) of a given antibody can be identified using the system described by Kabat et al., (1991) "Sequences of Proteins of Immunological Interest", 5th Ed., US Dept. of Health and Human Services, PHS, NIH, NIH Publication no. 91-3242. Although presented in the Kabat nomenclature scheme, as desired, the CDRs disclosed herein can also be redefined according an alternative nomenclature scheme, such as that of Chothia (see Chothia & Lesk, (1987) *J. Mol. Biol.* 196:901-917; Chothia et al., (1989) *Nature* 342:878-883 or Honegger & Pluckthun, (2001) *J. Mol. Biol.* 309:657-670). Certain antibodies that are disclosed herein comprise one or more amino acid sequences that are identical or have substantial sequence identity to the amino acid sequences of one or more of the CDRs presented in Table 3A (CDRHs) and Table 3B (CDRLs), infra.

TABLE 3A

Exemplary CDRH Sequences

| Clone | SEQ ID NO: | Contained in Reference | Designation | Sequence |
|---|---|---|---|---|
| 48C9 | 603 | $V_H73$ | CDRH1-1 | GYYWT |
| 49A12 | | $V_H73$ | | |
| 51E2 | | $V_H73$ | | |
| 48F3 | 604 | $V_H72$ | CDRH1-2 | GYYWS |
| 51E5 | | $V_H74$ | | |

TABLE 3A-continued

Exemplary CDRH Sequences

| Clone | SEQ ID NO: | Contained in Reference | Designation | Sequence |
|---|---|---|---|---|
| 52C5 | | $V_H$70 | | |
| 55E4 | | $V_H$70 | | |
| 60G5.1 | | $V_H$70 | | |
| 49B11 | | $V_H$70 | | |
| 50H10 | | $V_H$70 | | |
| 53C1 | | $V_H$70 | | |
| 56G1 | | $V_H$71 | | |
| 51C1 | | $V_H$89 | | |
| 48F8 | 605 | $V_H$48 | CDRH1-3 | SYSMN |
| 51G2 | | $V_H$50 | | |
| 56A7 | | $V_H$51 | | |
| 53B9 | | $V_H$48 | | |
| 56B4 | | $V_H$48 | | |
| 57E7 | | $V_H$48 | | |
| 57F11 | | $V_H$48 | | |
| 56E4 | | $V_H$51 | | |
| 55E6 | | $V_H$93 | | |
| 48H11 | 606 | $V_H$39 | CDRH1-4 | GYYKH |
| 48G4 | 607 | $V_H$83 | CDRH1-5 | ELSIH |
| 53C3.1 | | $V_H$83 | | |
| 49A10 | 608 | $V_H$62 | CDRH1-6 | NYGMH |
| 58C2 | | $V_H$85 | | |
| 59G10.2 | | $V_H$57 | | |
| 48D4 | | $V_H$62 | | |
| 49C8 | 609 | $V_H$44 | CDRH1-7 | SYDID |
| 52H1 | | $V_H$44 | | |
| 49G2 | 610 | $V_H$63 | CDRH1-8 | NYGMR |
| 50C12 | | $V_H$63 | | |
| 55G11 | | $V_H$63 | | |
| 49G3 | 611 | $V_H$46 | CDRH1-9 | NPRMGVS |
| 49H12 | 612 | $V_H$42 | CDRH1-10 | SYDIN |
| 54A1 | | $V_H$43 | | |
| 55G9 | | $V_H$43 | | |
| 50G1 | 613 | $V_H$84 | CDRH1-11 | SYGLH |
| 51A8 | 614 | $V_H$58 | CDRH1-12 | SYGMH |
| 52C1 | | $V_H$64 | | |
| 53H5.2 | | $V_H$59 | | |
| 56C11 | | $V_H$61 | | |
| 60D7 | | $V_H$66 | | |
| 64H5 | | $V_H$7 | | |
| 65G4 | | $V_H$8 | | |
| 66G2 | | $V_H$11 | | |
| 68G5 | | $V_H$12 | | |
| 64C8 | | $V_H$23 | | |
| 67G8 | | $V_H$27 | | |
| 68D3v2 | | | | |
| 51C10.1 | 615 | $V_H$54 | CDRH1-13 | NYAMS |
| 59D10v1 | | $V_H$54 | | |
| 59D10v2 | | $V_H$54 | | |
| 51C10.2 | 616 | $V_H$67 | CDRH1-14 | SGGYYWS |
| 64A6 | | $V_H$29 | | |
| 52A8 | 617 | $V_H$40 | CDRH1-15 | GYYLH |
| 66B4 | | $V_H$10 | | |
| 52B8 | 618 | $V_H$77 | CDRH1-16 | YYYWS |
| 52F8 | 619 | $V_H$41 | CDRH1-17 | GYYTH |
| 52H2 | 620 | $V_H$79 | CDRH1-18 | TYYWS |
| 53F6 | 621 | $V_H$60 | CDRH1-19 | TYGMH |

TABLE 3A-continued

Exemplary CDRH Sequences

| Clone | SEQ ID NO: | Contained in Reference | Designation | Sequence |
|---|---|---|---|---|
| 53H5.3 | 622 | $V_H75$ | CDRH1-20 | DYYWN |
| 54H10.1 | 623 | $V_H52$ | CDRH1-21 | SYAMS |
| 60F9 | | $V_H55$ | | |
| 61G5 | | $V_H56$ | | |
| 55D1 | | $V_H52$ | | |
| 48H3 | | $V_H52$ | | |
| 53C11 | | $V_H52$ | | |
| 48B4 | | $V_H55$ | | |
| 52D6 | | $V_H55$ | | |
| 55D3 | 624 | $V_H68$ | CDRH1-22 | SGVYYWN |
| 55E9 | 625 | $V_H65$ | CDRH1-23 | SFGMH |
| 55G5 | 626 | $V_H78$ | CDRH1-24 | SYYWS |
| 65C3 | | $V_H5$ | | |
| 68D5 | | $V_H5$ | | |
| 67F5 | | $V_H31$ | | |
| 55A7 | | $V_H92$ | | |
| 56E7 | 627 | $V_H81$ | CDRH1-25 | SYWIG |
| 67A5 | | $V_H34$ | | |
| 67C10 | | $V_H35$ | | |
| 64H6 | | $V_H36$ | | |
| 56G3.2 | 628 | $V_H80$ | CDRH1-26 | SYYWN |
| 56G3.3 | 629 | $V_H76$ | CDRH1-27 | SSSYYWG |
| 55B10 | | $V_H76$ | | |
| 61H5 | | $V_H86$ | | |
| 52B9 | | $V_H86$ | | |
| 57B12 | 630 | $V_H69$ | CDRH1-28 | SGVYYWS |
| 57D9 | 631 | $V_H82$ | CDRH1-29 | SNSATWN |
| 59A10 | 632 | $V_H47$ | CDRH1-30 | DSYMS |
| 49H4 | | $V_H47$ | | |
| 59C9 | 633 | $V_H49$ | CDRH1-31 | SYSMS |
| 58A5 | | $V_H49$ | | |
| 57A4 | | $V_H49$ | | |
| 57F9 | | $V_H49$ | | |
| 59G10.3 | 634 | $V_H53$ | CDRH1-32 | HYAMS |
| 60G5.2 | 635 | $V_H45$ | CDRH1-33 | NYGIS |
| 63G8 | 636 | $V_H1$ | CDRH1-34 | SYGIH |
| 64A8 | | $V_H1$ | | |
| 67B4 | | $V_H1$ | | |
| 68D3 | | $V_H1$ | | |
| 64E6 | 637 | $V_H2$ | CDRH1-35 | SGDYYWT |
| 65E8 | | $V_H2$ | | |
| 65F11 | | $V_H2$ | | |
| 67G7 | | $V_H2$ | | |
| 63H11 | | $V_H3$ | | |
| 63F5 | | $V_H13$ | | |
| 65C1 | | $V_H15$ | | |
| 66F6 | | $V_H14$ | | |
| 63B6 | 638 | $V_H4$ | CDRH1-36 | SGDYYWS |
| 64D4 | | $V_H4$ | | |
| 65F9 | | $V_H30$ | | |
| 64B10 | | $V_H32$ | | |
| 64B10v2 | | | | |
| 63E6 | 639 | $V_H6$ | CDRH1-37 | GYYMH |
| 66F7 | | $V_H6$ | | |
| 50G5 v1 | | $V_H88$ | | |
| 50G5 v2 | | $V_H88$ | | |

TABLE 3A-continued

Exemplary CDRH Sequences

| Clone | SEQ ID NO: | Contained in Reference | Designation | Sequence |
|---|---|---|---|---|
| 67G10v1 67G10v2 63A10 65H11 | 640 | $V_H9$ $V_H9 V_H21$ $V_H22$ | CDRH1-38 | NAWMS |
| 53C3.2 | 641 | $V_H90$ | CDRH1-39 | SGNYYWS |
| 64A7 | 642 | $V_H16$ | CDRH1-40 | SDTSYWG |
| 50D4 | 643 | $V_H87$ | CDRH1-41 | SHDIN |
| 61E1 | 644 | $V_H94$ | CDRH1-42 | SNSAAWN |
| 66D4 54H10.3 | 645 | $V_H17$ $V_H91$ | CDRH1-43 | GYYIH |
| 65B1 | 646 | $V_H18$ | CDRH1-44 | GYFMH |
| 67A4 | 647 | $V_H19$ | CDRH1-45 | TYDMH |
| 65B4 | 648 | $V_H20$ | CDRH1-46 | SYDMH |
| 65E3 | 649 | $V_H24$ | CDRH1-47 | NYNMH |
| 65D4 | 650 | $V_H25$ | CDRH1-48 | FYGMH |
| 65D1 | 651 | $V_H26$ | CDRH1-49 | YYYIH |
| 65B7 | 652 | $V_H28$ | CDRH1-50 | SDAYYWS |
| 68C8 | 653 | $V_H33$ | CDRH1-51 | SGDNYWS |
| 63F9 | 654 | $V_H37$ | CDRH1-52 | SGGYYWN |
| 67F6v1 67F6v2 | 655 | $V_H38$ $V_H38$ | CDRH1-53 | GYWIG |
| 48C9 52C5 55E4 56G1 49A12 51E2 60G5.1 49B11 50H10 53C1 51C1 | 656 | $V_H73$ $V_H70$ $V_H70$ $V_H71$ $V_H73$ $V_H73$ $V_H70$ $V_H70$ $V_H70$ $V_H70$ $V_H89$ | CDRH2-1 | EINHSENTNYNPSLKS |
| 48F3 | 657 | $V_H72$ | CDRH2-2 | EITHTGSSNYNPSLKS |
| 48F8 53B9 56B4 57E7 57F11 | 658 | $V_H48$ $V_H48$ $V_H48$ $V_H48$ $V_H48$ | CDRH2-3 | SISSSSSYEYYVDSVKG |
| 48H11 | 659 | $V_H39$ | CDRH2-4 | WINPNSGATKYAQKFQG |
| 48G4 53C3.1 | 660 | $V_H83$ $V_H83$ | CDRH2-5 | GFDPEDGETIYAQKFQG |
| 49A10 48D4 | 661 | $V_H62$ $V_H62$ | CDRH2-6 | IIWYDGSNKNYADSVKG |
| 49C8 52H1 | 662 | $V_H44$ $V_H44$ | CDRH2-7 | WMNPNGGNTGYAQKFQG |
| 49G2 50C12 55G11 | 663 | $V_H63$ $V_H63$ $V_H63$ | CDRH2-8 | LIWYDGSNKFYADSVKG |
| 49G3 | 664 | $V_H46$ | CDRH2-9 | HIFSNDEKSYSTSLKS |
| 49H12 | 665 | $V_H42$ | CDRH2-10 | WMNPYSGSTGYAQNFQG |

TABLE 3A-continued

Exemplary CDRH Sequences

| Clone | SEQ ID NO: | Contained in Reference | Designation | Sequence |
|---|---|---|---|---|
| 50G1 | 666 | $V_H84$ | CDRH2-11 | VIWNDGSNKLYADSVKG |
| 51A8<br>63G8<br>64A8<br>67B4<br>68D3 | 667 | $V_H58$<br>$V_H1$<br>$V_H1$<br>$V_H1$<br>$V_H1$ | CDRH2-12 | VISYDGSNKYYADSVKG |
| 51C10.1<br>59D10v1<br>59D10v2 | 668 | $V_H54$<br>$V_H54$<br>$V_H54$ | CDRH2-13 | GISGSSAGTYYADSVKG |
| 51C10.2 | 669 | $V_H67$ | CDRH2-14 | YIYYNGSPYDNPSLKR |
| 51E5 | 670 | $V_H74$ | CDRH2-15 | ELDHSGSINYNPSLKS |
| 51G2<br>56A7<br>56E4 | 671 | $V_H50$<br>$V_H51$<br>$V_H51$ | CDRH2-16 | SISSSSTYIYYADSVKG |
| 52A8 | 672 | $V_H40$ | CDRH2-17 | WINPNSAATNYAPKFQG |
| 52B8<br>55A7 | 673 | $V_H77$<br>$V_H92$ | CDRH2-18 | YIYYSGSTNYNPSLKS |
| 52C1 | 674 | $V_H64$ | CDRH2-19 | VIWYDGSNNYYADSVKG |
| 52F8 | 675 | $V_H41$ | CDRH2-20 | WINPSSGDTKYAQKFQG |
| 52H2 | 676 | $V_H79$ | CDRH2-21 | YIFYNGNANYSPSLKS |
| 53F6<br>60D7<br>65D4 | 677 | $V_H60$<br>$V_H66$<br>$V_H25$ | CDRH2-22 | VIWYDGSNKYYADSVKG |
| 53H5.2 | 678 | $V_H59$ | CDRH2-23 | LISYDGSNKYYADSVKG |
| 53H5.3 | 679 | $V_H75$ | CDRH2-24 | EINHSGTTNYNPSLKS |
| 54A1<br>55G9 | 680 | $V_H43$<br>$V_H43$ | CDRH2-25 | WMNPHSGNTGYAQKFQG |
| 54H10.1<br>55D1<br>48H3<br>53C11 | 681 | $V_H52$<br>$V_H52$<br>$V_H52$<br>$V_H52$ | CDRH2-26 | AISGSGRTTYSADSVKG |
| 55D3 | 682 | $V_H68$ | CDRH2-27 | YLYYSGSTYYNPSLKS |
| 55E9 | 683 | $V_H65$ | CDRH2-28 | LIWYDGDNKYYADSVKG |
| 55G5 | 684 | $V_H78$ | CDRH2-29 | RIYISGSTNYNPSLEN |
| 56C11 | 685 | $V_H61$ | CDRH2-30 | VIWYDGSYQFYADSVKG |
| 56E7<br>67A5<br>67C10<br>67F6v1<br>67F6v2 | 686 | $V_H81$<br>$V_H34$<br>$V_H35$<br>$V_H38$<br>$V_H38$ | CDRH2-31 | IIYPGDSDTRYSPSFQG |
| 56G3.2 | 687 | $V_H80$ | CDRH2-32 | RIYTSGSTNYNPSLKS |
| 56G3.3<br>55B10<br>56G3.3 | 688 | $V_H76$<br>$V_H76$<br>$V_H76$ | CDRH2-33 | MIYYSGTTYYNPSLKS |
| 57B12<br>63H11<br>66F6<br>65F9 | 689 | $V_H69$<br>$V_H3$<br>$V_H14$<br>$V_H30$ | CDRH2-34 | YIYYSGSTYYNPSLKS |
| 57D9<br>61E1 | 690 | $V_H82$<br>$V_H94$ | CDRH2-35 | RTYYRSKWYNDYAVSVKS |

TABLE 3A-continued

Exemplary CDRH Sequences

| Clone | SEQ ID NO: | Contained in Reference | Designation | Sequence |
|---|---|---|---|---|
| 58C2 | 691 | $V_H 85$ | CDRH2-36 | VIWNDGNNKYYADSVKG |
| 59A10 | 692 | $V_H 47$ | CDRH2-37 | SISSSGSIVYFADSVKG |
| 49H4 | | $V_H 47$ | | |
| 59C9 | 693 | $V_H 49$ | CDRH2-38 | SISSSSTYIYYADSLKG |
| 58A5 | | $V_H 49$ | | |
| 57A4 | | $V_H 49$ | | |
| 57F9 | | $V_H 49$ | | |
| 59G10.2 | 694 | $V_H 57$ | CDRH2-39 | ITSYGGSNKNYADSVKG |
| 59G10.3 | 695 | $V_H 53$ | CDRH2-40 | AISGSGAGTFYADSMKG |
| 60F9 | 696 | $V_H 55$ | CDRH2-41 | VISDSGGSTYYADSVKG |
| 48B4 | | $V_H 55$ | | |
| 52D6 | | $V_H 55$ | | |
| 60G5.2 | 697 | $V_H 45$ | CDRH2-42 | WISAYNGYSNYAQKFQD |
| 61G5 | 698 | $V_H 56$ | CDRH2-43 | VISGSGGDTYYADSVKG |
| 64E6 | 699 | $V_H 2$ | CDRH2-44 | YIYYTGSTYYNPSLKS |
| 65E8 | | $V_H 2$ | | |
| 65F11 | | $V_H 2$ | | |
| 67G7 | | $V_H 2$ | | |
| 63B6 | 700 | $V_H 4$ | CDRH2-45 | YIYYSGTTYYNPSLKS |
| 64D4 | | $V_H 4$ | | |
| 65C3 | 701 | $V_H 5$ | CDRH2-46 | YIYYTGSTNYNPSLKS |
| 68D5 | | $V_H 5$ | | |
| 63E6 | 702 | $V_H 6$ | CDRH2-47 | WMNPNSGATKYAQKFQG |
| 66F7 | | $V_H 6$ | | |
| 64H5 | 703 | $V_H 7$ | CDRH2-48 | VIWDDGSNKYYADSVKG |
| 65G4 | | $V_H 8$ | | |
| 67G10v1 | 704 | $V_H 9$ | CDRH2-49 | RIKSKTDGGTTEYAAPVKG |
| 67G10v2 | | $V_H 9$ | | |
| 63F5 | 705 | $V_H 13$ | CDRH2-50 | YIYYSGSAYYNPSLKS |
| 64A7 | 706 | $V_H 16$ | CDRH2-51 | NIYYSGTTYFNPSLKS |
| 65C1 | 707 | $V_H 15$ | CDRH2-52 | YIFYSGSTYYNPSLKS |
| 65B7 | | $V_H 28$ | | |
| 66B4 | 708 | $V_H 10$ | CDRH2-53 | WINPSGGTDYAQKFQG |
| 66G2 | 709 | $V_H 11$ | CDRH2-54 | GISYDGSNKNYADSVKG |
| 68G5 | 710 | $V_H 12$ | CDRH2-55 | VIWYDGSNKYHADSVKG |
| 66D4 | 711 | $V_H 17$ | CDRH2-56 | WINPPSGATNYAQKFRG |
| 65B1 | 712 | $V_H 18$ | CDRH2-57 | WINPNSGATNYAQKFHG |
| 67A4 | 713 | $V_H 19$ | CDRH2-58 | AIGIAGDTYYSDSVKG |
| 65B4 | 714 | $V_H 20$ | CDRH2-59 | TIDTAGDAYYPGSVKG |
| 63A10 | 715 | $V_H 21$ | CDRH2-60 | RIKSKTDGGTTDYAAPVKG |
| 67G10v1 | | | | |
| 67G10v2 | | | | |
| 65H11 | 716 | $V_H 22$ | CDRH2-61 | RIIGKTDGGTTDYAAPVKG |
| 64C8 | 717 | $V_H 23$ | CDRH2-62 | VISYDGSNKHYADSVKG |
| 65E3 | 718 | $V_H 24$ | CDRH2-63 | VLWYDGNTKYYADSVKG |
| 65D1 | 719 | $V_H 26$ | CDRH2-64 | LIWYDGSNKDYADSVKG |

TABLE 3A-continued

Exemplary CDRH Sequences

| Clone | SEQ ID NO: | Contained in Reference | Designation | Sequence |
|---|---|---|---|---|
| 67G8 | 720 | $V_H27$ | CDRH2-65 | VIWYDGSNKDYADSVKG |
| 64A6 | 721 | $V_H29$ | CDRH2-66 | YIYYSGGTHYNPSLKS |
| 67F5 | 722 | $V_H31$ | CDRH2-67 | YIYYSGNTNYNPSLKS |
| 64B10 | 723 | $V_H32$ | CDRH2-68 | FIYYSGGTNYNPSLKS |
| 68C8 | 724 | $V_H33$ | CDRH2-69 | FMFYSGSTNYNPSLKS |
| 64H6 | 725 | $V_H36$ | CDRH2-70 | IIYPGDSETRYSPSFQG |
| 63F9 | 726 | $V_H37$ | CDRH2-71 | YIYDSGSTYYNPSLKS |
| 61H5 52B9 | 727 | $V_H86$ $V_H86$ | CDRH2-72 | SIYYSGTTYYNPSLKS |
| 50G5v1 50G5v2 | 728 | $V_H88$ $V_H88$ | CDRH2-73 | WINPDSGGTNYAQKFQG |
| 54H10.3 | 729 | $V_H91$ | CDRH2-74 | WINPNSGGTNYAQKFRG |
| 50D4 | 730 | $V_H87$ | CDRH2-75 | WMNPYSGSTGLAQRFQD |
| 55E6 | 731 | $V_H93$ | CDRH2-76 | YISSGSSTIYHADSVKG |
| 53C3.2 | 732 | $V_H90$ | CDRH2-77 | YIYHSGSAYYNPSLKS |
| 64B10v2 | 1868 | $V_H96$ | CDRH2-78 | FIYYSGGTNYNPPLKS |
| 68D3v2 | 1869 | $V_H95$ | CDRH2-79 | FISYAGSNKYYADSVKG |
| 48C9 49A12 51E2 | 733 | $V_H73$ $V_H73$ $V_H73$ | CDRH3-1 | ESGNFPFDY |
| 48F3 | 734 | $V_H72$ | CDRH3-2 | GGILWFGEQAFDI |
| 48F8 53B9 56B4 57E7 57F11 | 735 | $V_H48$ $V_H48$ $V_H48$ $V_H48$ $V_H48$ | CDRH3-3 | SLSIAVAASDY |
| 48H11 | 736 | $V_H39$ | CDRH3-4 | EVPDGIVVAGSNAFDF |
| 48G4 53C3.1 | 737 | $V_H83$ $V_H83$ | CDRH3-5 | HSGSGRFYYYYYGMDV |
| 49A10 48D4 | 738 | $V_H62$ $V_H62$ | CDRH3-6 | DQDYDFWSGYPYFYYYGMDV |
| 49C8 52H1 | 739 | $V_H44$ $V_H44$ | CDRH3-7 | GKEFSRAEFDY |
| 49G2 50C12 55G11 | 740 | $V_H63$ $V_H63$ $V_H63$ | CDRH3-8 | DRYYDFWSGYPYFFYYGLDV |
| 49G3 | 741 | $V_H46$ | CDRH3-9 | VDTLNYHYYGMDV |
| 49H12 54A1 55G9 | 742 | $V_H42$ $V_H43$ $V_H43$ | CDRH3-10 | YNWNYGAFDF |
| 50G1 | 743 | $V_H84$ | CDRH3-11 | DQYYDFWSGYPYYHYYGMDV |
| 51A8 | 744 | $V_H58$ | CDRH3-12 | ADGDYPYYYYYGMDV |
| 51C10.1 59D10v1 59D10v2 | 745 | $V_H54$ $V_H54$ $V_H54$ | CDRH3-13 | DWSIAVAGTFDY |
| 51C10.2 | 746 | $V_H67$ | CDRH3-14 | GALYGMDV |

TABLE 3A-continued

Exemplary CDRH Sequences

| Clone | SEQ ID NO: | Contained in Reference | Designation | Sequence |
|---|---|---|---|---|
| 51E5 | 747 | $V_H74$ | CDRH3-15 | VLGSTLDY |
| 51G2 | 748 | $V_H50$ | CDRH3-16 | DTYISGWNYGMDV |
| 52A8 | 749 | $V_H40$ | CDRH3-17 | EGGTYNWFDP |
| 52B8 | 750 | $V_H77$ | CDRH3-18 | GTRAFDI |
| 52C1 | 751 | $V_H64$ | CDRH3-19 | DRAGASPGMDV |
| 52C5 | 752 | $V_H70$ | CDRH3-20 | VTGTDAFDF |
| 60G5.1 | | $V_H70$ | | |
| 49B11 | | $V_H70$ | | |
| 50H10 | | $V_H70$ | | |
| 53C1 | | $V_H70$ | | |
| 51C1 | | $V_H89$ | | |
| 55E4 | | $V_H70$ | | |
| 56G1 | | $V_H71$ | | |
| 52F8 | 753 | $V_H41$ | CDRH3-21 | SGWYPSYYYGMDV |
| 52H2 | 754 | $V_H79$ | CDRH3-22 | ETDYGDYARPFEY |
| 53F6 | 755 | $V_H60$ | CDRH3-23 | GHYDSSGPRDY |
| 53H5.2 | 756 | $V_H59$ | CDRH3-24 | EANWGYNYYGMDV |
| 53H5.3 | 757 | $V_H75$ | CDRH3-25 | ILRYFDWLEYYFDY |
| 61E1 | 758 | $V_H94$ | CDRH3-26 | EGSWSSFFDY |
| 54H10 | 759 | $V_H52$ | CDRH3-27 | EQQWLVYFDY |
| 55D1 | | $V_H52$ | | |
| 48H3 | | $V_H52$ | | |
| 53C11 | | $V_H52$ | | |
| 55D3 | 760 | $V_H68$ | CDRH3-28 | DGITMVRGVTHYYGMDV |
| 57B12 | | $V_H69$ | | |
| 55E6 | 761 | $V_H93$ | CDRH3-29 | EGYYDSSGYYYNGMDV |
| 55E9 | 762 | $V_H65$ | CDRH3-30 | NSGWDYFYYYGMDV |
| 55G5 | 763 | $V_H78$ | CDRH3-31 | SGSYSFDY |
| 56A7 | 764 | $V_H51$ | CDRH3-32 | DIYSSGWSYGMDV |
| 56E4 | | $V_H51$ | | |
| 56C11 | 765 | $V_H61$ | CDRH3-33 | DHVWRTYRYIFDY |
| 56E7 | 766 | $V_H81$ | CDRH3-34 | AQLGIFDY |
| 50G5v1 | 767 | $V_H88$ | CDRH3-35 | GGYSYGYEDYYGMDV |
| 50G5v2 | | $V_H88$ | | |
| 56G3.2 | 768 | $V_H80$ | CDRH3-36 | GPLWFDY |
| 56G3.3 | 769 | $V_H76$ | CDRH3-37 | VAAVYWYFDL |
| 55B10 | | $V_H76$ | | |
| 61H5 | | $V_H86$ | | |
| 52B9 | | $V_H86$ | | |
| 55A7 | 770 | $V_H92$ | CDRH3-38 | GITGTIDF |
| 57D9 | 771 | $V_H82$ | CDRH3-39 | IVVVPAVLFDY |
| 58C2 | 772 | $V_H85$ | CDRH3-40 | DQNYDFWNGYPYYFYYGMDV |
| 59A10 | 773 | $V_H47$ | CDRH3-41 | ETFSSGWFDAFDI |
| 49H4 | | $V_H47$ | | |
| 59C9 | 774 | $V_H49$ | CDRH3-42 | DRWSSGWNEGFDY |
| 58A5 | | $V_H49$ | | |
| 57A4 | | $V_H49$ | | |
| 57F9 | | $V_H49$ | | |

TABLE 3A-continued

Exemplary CDRH Sequences

| Clone | SEQ ID NO: | Contained in Reference | Designation | Sequence |
|---|---|---|---|---|
| 53C3.2 | 775 | V$_H$90 | CDRH3-43 | TTGASDI |
| 59G10.2 | 776 | V$_H$57 | CDRH3-44 | EAGYSFDY |
| 59G10.3 | 777 | V$_H$53 | CDRH3-45 | DLRIAVAGSFDY |
| 60D7 | 778 | V$_H$66 | CDRH3-46 | DQYFDFWSGYPFFYYYGMDV |
| 60F9 | 779 | V$_H$55 | CDRH3-47 | DHSSGWYYYGMDV |
| 48B4 | | V$_H$55 | | |
| 52D6 | | V$_H$55 | | |
| 60G5.2 | 780 | V$_H$45 | CDRH3-48 | EEKQLVKDYYYYGMDV |
| 61G5 | 781 | V$_H$56 | CDRH3-49 | DHTSGWYYYGMDV |
| 63G8 | 782 | V$_H$1 | CDRH3-50 | TVTKEDYYYYGMDV |
| 64A8 | | V$_H$1 | | |
| 67B4 | | V$_H$1 | | |
| 68D3 | | V$_H$1 | | |
| 66G2 | | V$_H$11 | | |
| 64E6 | 783 | V$_H$2 | CDRH3-51 | MTTPYWYFDL |
| 65E8 | | V$_H$2 | | |
| 65F11 | | V$_H$2 | | |
| 67G7 | | V$_H$2 | | |
| 63H11 | | V$_H$3 | | |
| 63F5 | | V$_H$13 | | |
| 66F6 | | V$_H$14 | | |
| 63B6 | 784 | V$_H$4 | CDRH3-52 | MTTPYWYFGL |
| 64D4 | | V$_H$4 | | |
| 65C3 | 785 | V$_H$5 | CDRH3-53 | EYYYGSGSYYP |
| 68D5 | | V$_H$5 | | |
| 67F5 | | V$_H$31 | | |
| 63E6 | 786 | V$_H$6 | CDRH3-54 | ELGDYPFFDY |
| 66F7 | | V$_H$6 | | |
| 64H5 | 787 | V$_H$7 | CDRH3-55 | EYVAEAGFDY |
| 65G4 | | V$_H$8 | | |
| 67G10v1 | 788 | V$_H$9 | CDRH3-56 | DSSGSYYVEDYFDY |
| 67G10 v2 | | V$_H$9 | | |
| 63A10 | | V$_H$21 | | |
| 65H11 | | V$_H$22 | | |
| 64A7 | 789 | V$_H$16 | CDRH3-57 | LRGVYWYFDL |
| 65C1 | 790 | V$_H$15 | CDRH3-58 | MTSPYWYFDL |
| 66B4 | 791 | V$_H$10 | CDRH3-59 | DAATGRYYFDN |
| 68G5 | 792 | V$_H$12 | CDRH3-60 | DPGYSYGHFDY |
| 66D4 | 793 | V$_H$17 | CDRH3-61 | ETGTWSFFDY |
| 65B1 | 794 | V$_H$18 | CDRH3-62 | ELGIFNWFDP |
| 67A4 | 795 | V$_H$19 | CDRH3-63 | DRSSGRFGDYYGMDV |
| 65B4 | 796 | V$_H$20 | CDRH3-64 | DRSSGRFGDFYGMDV |
| 64C8 | 797 | V$_H$23 | CDRH3-65 | ELLWFGEYGVDHGMDV |
| 65E3 | 798 | V$_H$24 | CDRH3-66 | DVYGDYFAY |
| 65D4 | 799 | V$_H$25 | CDRH3-67 | ALNWNFFDY |
| 65D1 | 800 | V$_H$26 | CDRH3-68 | EGTTRRGFDY |
| 67G8 | 801 | V$_H$27 | CDRH3-69 | SAVALYNWFDP |
| 65B7 | 802 | V$_H$28 | CDRH3-70 | ESRILYFNGYFQH |

TABLE 3A-continued

Exemplary CDRH Sequences

| Clone | SEQ ID NO: | Contained in Reference | Designation | Sequence |
|---|---|---|---|---|
| 64A6 | 803 | $V_H29$ | CDRH3-71 | VLHYSDSRGYSYYSDF |
| 65F9 | 804 | $V_H30$ | CDRH3-72 | VLHYYDSSGYSYYFDY |
| 64B10v1 64B10v2 | 805 | $V_H32$ $V_H32$ | CDRH3-73 | YSSTWDYYYGVDV |
| 68C8 | 806 | $V_H33$ | CDRH3-74 | YRSDWDYYYGMDV |
| 67A5 | 807 | $V_H34$ | CDRH3-75 | RASRGYRFGLAFAI |
| 67C10 | 808 | $V_H35$ | CDRH3-76 | RASRGYRYGLAFAI |
| 64H6 | 809 | $V_H36$ | CDRH3-77 | VAVSAFNWFDP |
| 63F9 | 810 | $V_H37$ | CDRH3-78 | DVLMVYTKGGYYYYGVDV |
| 67F6v1 67F6v2 | 811 | $V_H38$ $V_H38$ | CDRH3-79 | RASRGYSYGHAFDF |
| 50D4 | 812 | $V_H87$ | CDRH3-80 | DLSSGYYYYGLDV |
| 54H10.3 | 813 | $V_H91$ | CDRH3-81 | EEDYSDHHYFDY |
| 66D4 | 1870 | $V_H17$ | CDRH3-82 | ETGTWNFFDY |
| 68D3v2 | 1871 | $V_H95$ | CDRH3-83 | TVTEEDYYYGMDV |

TABLE 3B

Exemplary CDRL Sequences

| Clone | SEQ ID NO: | Contained in Reference | Designation | Amino Acid Sequence |
|---|---|---|---|---|
| 48C9 49A12 51E2 | 814 | $V_L78$ $V_L78$ $V_L78$ | CDRL1-1 | RASQNIRTYLN |
| 48F3 | 815 | $V_L77$ | CDRL1-2 | RASQRISSYLN |
| 48F8 53B9 56B4 57E7 57F11 | 816 | $V_L49$ $V_L49$ $V_L49$ $V_L49$ $V_L49$ | CDRL1-3 | RASQDIGNSLH |
| 48H11 | 817 | $V_L40$ | CDRL1-4 | RASQNIRSYLN |
| 49A10 48D4 | 818 | $V_L65$ $V_L65$ | CDRL1-5 | RSSQSLLDSDDGNTYLD |
| 49C8 52H1 | 819 | $V_L45$ $V_L45$ | CDRL1-6 | QASQDINIYLN |
| 49G2 50C12 55G11 60D7 50G1 | 820 | $V_L66$ $V_L66$ $V_L66$ $V_L69$ $V_L90$ | CDRL1-7 | RSSQSLLDSDDGDTYLD |
| 49G3 | 821 | $V_L47$ | CDRL1-8 | QASQGISNYLN |
| 49H12 | 822 | $V_L43$ | CDRL1-9 | QASQDITKYLN |
| 51A8 | 823 | $V_L61$ | CDRL1-10 | TRSSGSIASDYVQ |
| 51C10.1 | 824 | $V_L55$ | CDRL1-11 | SGDALPKKYAY |
| 51C10.2 | 825 | $V_L70$ | CDRL1-12 | SGDELGDKYAC |
| 51E5 63G8v1 64A8 67B4 68D3 | 826 | $V_L79$ $V_L104$ $V_L1$ $V_L1$ $V_L2$ | CDRL1-13 | RASQDIRNDLG |
| 51G2 59A10 49H4 | 827 | $V_L51$ $V_L48$ $V_L48$ | CDRL1-14 | RASQGISSWLA |
| 52A8 | 828 | $V_L41$ | CDRL1-15 | RASQTISSYLN |
| 52B8 | 829 | $V_L82$ | CDRL1-16 | RASQSVSDILA |
| 52C1 | 830 | $V_L67$ | CDRL1-17 | SGSSSNIGINYVS |
| 52C5 55E4 49B11 50H10 53C1 56G1 51C1 60G5.1 | 831 | $V_L73$ $V_L75$ $V_L75$ $V_L75$ $V_L75$ $V_L76$ $V_L95$ $V_L74$ | CDRL1-18 | RASQSISNYLN |
| 52F8 | 832 | $V_L42$ | CDRL1-19 | RSSQSLLHSNGYNYLD |
| 52H2 | 833 | $V_L84$ | CDRL1-20 | RASQSVRSSYLA |
| 53F6 | 834 | $V_L63$ | CDRL1-21 | RSSQSLQHSNGYNYLD |
| 53H5.2 50G5 v1 66G2 | 835 | $V_L62$ $V_L93$ $V_L12$ | CDRL1-22 | RASQGIRNDLG |
| 53H5.3 | 836 | $V_L80$ | CDRL1-23 | RASQSVSSNVA |

TABLE 3B-continued

Exemplary CDRL Sequences

| Clone | SEQ ID NO: | Contained in Reference | Designation | Amino Acid Sequence |
|---|---|---|---|---|
| 54A1 | 837 | $V_L44$ | CDRL1-24 | QASQDISIYLN |
| 55G9 | | $V_L44$ | | |
| 54H10.1 | 838 | $V_L53$ | CDRL1-25 | RASQSFSSSYLA |
| 55D1 | | $V_L53$ | | |
| 48H3 | | $V_L53$ | | |
| 53C11 | | $V_L53$ | | |
| 55D3 | 839 | $V_L71$ | CDRL1-26 | RASQDISNYLA |
| 50D4 | | $V_L92$ | | |
| 55E9 | 840 | $V_L68$ | CDRL1-27 | RSSQSLLHSNGFNYLD |
| 55G5 | 841 | $V_L83$ | CDRL1-28 | SGDNLGDKYAF |
| 56A7 | 842 | $V_L52$ | CDRL1-29 | RASQDISSWLA |
| 56E4 | | $V_L52$ | | |
| 56C11 | 843 | $V_L64$ | CDRL1-30 | GGNDIGSKSVH |
| 56E7 | 844 | $V_L86$ | CDRL1-31 | QASQDIKKFLN |
| 56G3.2 | 845 | $V_L85$ | CDRL1-32 | RARQSVGSNLI |
| 56G3.3 | 846 | $V_L81$ | CDRL1-33 | RASQSVSRDYLA |
| 55B10 | | $V_L81$ | | |
| 61H5 | | $V_L88$ | | |
| 52B9 | | $V_L88$ | | |
| 57B12 | 847 | $V_L72$ | CDRL1-34 | RASHDISNYLA |
| 57D9 | 848 | $V_L87$ | CDRL1-35 | RASPSVSSSYLA |
| 53C3.2 | 849 | $V_L96$ | CDRL1-36 | RASQSISSNLA |
| 59C9 | 850 | $V_L50$ | CDRL1-37 | RASQDIDSWLV |
| 58A5 | | $V_L50$ | | |
| 57A4 | | $V_L50$ | | |
| 57F9 | | $V_L50$ | | |
| 59D10 v1 | 851 | $V_L56$ | CDRL1-38 | SGDAVPKKYAN |
| 59D10 v2 | 852 | $V_L57$ | CDRL1-39 | SGDKLGDKYVC |
| 65D1 | | $V_L27$ | | |
| 59G10.2 | 853 | $V_L60$ | CDRL1-40 | SGDNLGDKYAC |
| 59G10.3 | 854 | $V_L54$ | CDRL1-41 | SGSSSNIGDNYVS |
| 54H10.3 | 855 | $V_L97$ | CDRL1-84 | RASQTISIYLN |
| 60F9 | 856 | $V_L58$ | CDRL1-43 | RASQRVPSSYIV |
| 48B4 | | $V_L58$ | | |
| 52D6 | | $V_L58$ | | |
| 60G5.2 | 857 | $V_L46$ | CDRL1-44 | SGNKLGDKYVC |
| 61G5 | 858 | $V_L59$ | CDRL1-45 | RASQRVPSSYLV |
| 64E6 | 859 | $V_L3$ | CDRL1-46 | RASQSVRNSYLA |
| 65E8 | | $V_L3$ | | |
| 65F11 | | $V_L3$ | | |
| 67G7 | | $V_L3$ | | |
| 63H11 | | $V_L3$ | | |
| 66F6 | | $V_L15$ | | |
| 63B6 | 860 | $V_L4$ | CDRL1-47 | RASQSVSNSYLA |
| 64D4 | | $V_L4$ | | |
| 65C3 | 861 | $V_L5$ | CDRL1-48 | RASQSVSSQLA |
| 68D5 | | $V_L5$ | | |
| 63E6 | 862 | $V_L6$ | CDRL1-49 | RTSQSISSYLN |
| 66F7 | 863 | $V_L7$ | CDRL1-50 | RTSQSISNYLN |
| 64H5 | 864 | $V_L8$ | CDRL1-51 | GGNNIGSKNVH |
| 65G4 | | $V_L8$ | | |
| 65E3 | | $V_L25$ | | |
| 64H6 | | $V_L37$ | | |
| 67G10 v1 | 865 | $V_L9$ | CDRL1-52 | GGNNIGSKAVH |
| 63A10 v1 | | $V_L22$ | | |
| 63A10v2 | | $V_L101$ | | |
| 67G10 v2 | 866 | $V_L10$ | CDRL1-53 | SGDKLGDKYAC |
| 63F5 | 867 | $V_L14$ | CDRL1-54 | RASQTVRNNYLA |
| 64A7 | 868 | $V_L17$ | CDRL1-55 | RASQSVSRNYLA |
| 65C1 | 869 | $V_L16$ | CDRL1-56 | RASQTIRNSYLA |
| 66B4 | 870 | $V_L11$ | CDRL1-57 | RASQGISRWLA |
| 55A7 | 871 | $V_L98$ | CDRL1-58 | RASQSISSYLN |
| 68G5 | 872 | $V_L13$ | CDRL1-59 | GGNNIGSINVH |
| 66D4 | 873 | $V_L18$ | CDRL1-60 | RASQIISRYLN |
| 65B1 | 874 | $V_L19$ | CDRL1-61 | RASQNINNYLN |
| 67A4 | 875 | $V_L20$ | CDRL1-62 | GGNNIGSKSVH |
| 65B4 | 876 | $V_L21$ | CDRL1-63 | GGNNIGSKSVQ |
| 55E6 | 877 | $V_L99$ | CDRL1-64 | RASQSVSRSHLA |
| 65H11 | 878 | $V_L23$ | CDRL1-65 | GGNNIGSKTVH |
| 64C8 | 879 | $V_L24$ | CDRL1-66 | RSSPSLVYSDGNTYLN |
| 65D4 | 880 | $V_L26$ | CDRL1-67 | GGNDIGSKNVH |
| 61E1 | 881 | $V_L100$ | CDRL1-68 | RASQSIGTFLN |
| 67G8 | 882 | $V_L28$ | CDRL1-69 | GGNNIGSYNVF |
| 65B7 | 883 | $V_L29$ | CDRL1-70 | RASQSVSSMYLA |
| 64A6 | 884 | $V_L30$ | CDRL1-71 | RASQSVNSNLA |
| 65F9 | 885 | $V_L31$ | CDRL1-72 | RASQSVSSNLA |
| 67F5 | | $V_L32$ | | |
| 64B10 | 886 | $V_L33$ | CDRL1-73 | SGSSSNIGNNYVA |
| 68C8 | 887 | $V_L34$ | CDRL1-74 | SGSSSNIGNNYVS |
| 67A5 | 888 | $V_L35$ | CDRL1-75 | RSSQSLLNSDDGNTYLD |
| 67C10 | | $V_L36$ | | |
| 63F9 | 889 | $V_L38$ | CDRL1-76 | RASQDIRNDLA |
| 67F6v1 | 890 | $V_L39$ | CDRL1-77 | RSSQSLLNSDAGTTYLD |
| 50G5v2 | 891 | $V_L94$ | CDRL1-78 | RSSQRLVYSDGNTYLN |
| 48G4 | 892 | $V_L89$ | CDRL1-79 | RASQSVASSYLV |
| 53C3.1 | | $V_L89$ | | |
| 58C2 | 893 | $V_L91$ | CDRL1-81 | RSSQSLFDNDDGDTYLD |
| 68G8v2 | 1872 | $V_L105$ | CDRL1-82 | RASQGIRSGLG |
| 68G8v3 | | $V_L106$ | | |
| 65B7v1 | 1873 | $V_L29$ | CDRL1-83 | RASQSVSSIYLA |

TABLE 3B-continued

Exemplary CDRL Sequences

| Clone | SEQ ID NO: | Contained in Reference | Designation | Amino Acid Sequence |
|---|---|---|---|---|
| 67F6v2 | 1874 | $V_L$108 | CDRL1-84 | RSSQSLLNSDAGTTYLD |
| 65B7v2 | 1875 | $V_L$107 | CDRL1-85 | RSSQSLVYSDGDTYLN |
| 65H11v2 | 1876 | $V_L$103 | CDRL1-86 | SGDKLGDRYVC |
| 63A10v3 | 1877 | $V_L$102 | CDRL1-87 | SGDKLGNRYTC |
| 48C9 | 894 | $V_L$78 | CDRL2-1 | VASSLES |
| 49A12 | | $V_L$78 | | |
| 51E2 | | $V_L$78 | | |
| 48F3 | 895 | $V_L$77 | CDRL2-2 | AVSSLQS |
| 48F8 | 896 | $V_L$49 | CDRL2-3 | FASQSFS |
| 53B9 | | $V_L$49 | | |
| 56B4 | | $V_L$49 | | |
| 57E7 | | $V_L$49 | | |
| 57F11 | | $V_L$49 | | |
| 48H11 | 897 | $V_L$40 | CDRL2-4 | GASNLQS |
| 49A10 | 898 | $V_L$65 | CDRL2-5 | TLSYRAS |
| 48D4 | | $V_L$65 | | |
| 49G2 | | $V_L$66 | | |
| 50C12 | | $V_L$66 | | |
| 55G11 | | $V_L$66 | | |
| 60D7 | | $V_L$69 | | |
| 67A5 | | $V_L$35 | | |
| 67C10 | | $V_L$36 | | |
| 50G1 | | $V_L$90 | | |
| 58C2 | | $V_L$91 | | |
| 49C8 | 899 | $V_L$45 | CDRL2-6 | DVSNLET |
| 52H1 | | $V_L$45 | | |
| 54A1 | | $V_L$44 | | |
| 55G9 | | $V_L$44 | | |
| 49G3 | 900 | $V_L$47 | CDRL2-7 | DASNLET |
| 56E7 | | $V_L$86 | | |
| 49H12 | 901 | $V_L$43 | CDRL2-8 | DTFILET |
| 51A8 | 902 | $V_L$61 | CDRL2-9 | EDKERSS |
| 51C10.1 | 903 | $V_L$55 | CDRL2-10 | EDSKRPS |
| 59D10v1 | | $V_L$56 | | |
| 51C10.2 | 904 | $V_L$70 | CDRL2-11 | QDTKRPS |
| 59G10.2 | | $V_L$60 | | |
| 51E5 | 905 | $V_L$79 | CDRL2-12 | AASSLQF |
| 51G2 | 906 | $V_L$51 | CDRL2-13 | DASSLQS |
| 52A8 | 907 | $V_L$41 | CDRL2-14 | AASSLQS |
| 52C5 | | $V_L$73 | | |
| 53H5.2 | | $V_L$62 | | |
| 55D3 | | $V_L$71 | | |
| 56G1 | | $V_L$76 | | |
| 57B12 | | $V_L$72 | | |
| 63E6 | | $V_L$6 | | |
| 66F7 | | $V_L$7 | | |
| 66D4 | | $V_L$18 | | |
| 50G5 v1 | | $V_L$93 | | |
| 51C1 | | $V_L$95 | | |
| 55A7 | | $V_L$98 | | |
| 61E1 | | $V_L$100 | | |
| 60G5.1 | | $V_L$74 | | |
| 52B8 | 908 | $V_L$82 | CDRL2-15 | GASTRAT |
| 53H5.3 | | $V_L$80 | | |
| 65F9 | | $V_L$31 | | |
| 52C1 | 909 | $V_L$67 | CDRL2-16 | DNNKRPS |
| 59G10.3 | | $V_L$54 | | |
| 68C8 | | $V_L$34 | | |
| 52F8 | 910 | $V_L$42 | CDRL2-17 | LGSNRAS |
| 55E9 | | $V_L$68 | | |
| 52H2 | 911 | $V_L$84 | CDRL2-18 | GASRRAT |
| 53F6 | 912 | $V_L$63 | CDRL2-19 | LDSNRAS |
| 54H10.1 | 913 | $V_L$53 | CDRL2-20 | GASSRAT |
| 55D1 | | $V_L$53 | | |
| 48H3 | | $V_L$53 | | |
| 53C11 | | $V_L$53 | | |
| 57D9 | | $V_L$87 | | |
| 61H5 | | $V_L$88 | | |
| 52B9 | | $V_L$88 | | |
| 63F5 | | $V_L$14 | | |
| 64A7 | | $V_L$17 | | |
| 65B7 | | $V_L$29 | | |
| 55E6 | | $V_L$99 | | |
| 55E4 | 914 | $V_L$75 | CDRL2-21 | TASSLQS |
| 49B11 | | $V_L$75 | | |
| 50H10 | | $V_L$75 | | |
| 53C1 | | $V_L$75 | | |
| 50G5v2 | 915 | $V_L$94 | CDRL2-22 | KVSNWDS |
| 65B7v2 | | | | |
| 55G5 | 916 | $V_L$83 | CDRL2-23 | QDNKRPS |
| 56A7 | 917 | $V_L$52 | CDRL2-24 | DASTLQS |
| 56E4 | | $V_L$52 | | |
| 56C11 | 918 | $V_L$64 | CDRL2-25 | DDSDRPS |
| 67A4 | | $V_L$20 | | |
| 65B4 | | $V_L$21 | | |
| 56G3.2 | 919 | $V_L$85 | CDRL2-26 | GASSRDT |
| 56G3.3 | 920 | $V_L$81 | CDRL2-27 | GASARAT |
| 55B10 | | $V_L$81 | | |
| 59A10 | 921 | $V_L$48 | CDRL2-28 | GASSLQS |
| 49H4 | | $V_L$48 | | |
| 59C9 | 922 | $V_L$50 | CDRL2-29 | AASNLQR |
| 58A5 | | $V_L$50 | | |
| 57A4 | | $V_L$50 | | |
| 57F9 | | $V_L$50 | | |
| 63G8v1 | | $V_L$1 | | |
| 63G8v2 | | $V_L$1 | | |
| 63G8v3 | | $V_L$1 | | |
| 64A8 | | $V_L$2 | | |
| 67B4 | | | | |
| 68D3 | | | | |
| 59D10 v2 | 923 | $V_L$57 | CDRL2-30 | QNNKRPS |
| 60F9 | 924 | $V_L$58 | CDRL2-31 | GSSNRAT |
| 48B4 | | $V_L$58 | | |
| 52D6 | | $V_L$58 | | |
| 60G5.2 | 925 | $V_L$46 | CDRL2-32 | QDSKRPS |
| 65D1 | | $V_L$27 | | |
| 65H11v2 | | | | |
| 61G5 | 926 | $V_L$59 | CDRL2-33 | GASNRAT |
| 64E6 | 927 | $V_L$3 | CDRL2-34 | GAFSRAS |
| 65E8 | | $V_L$3 | | |
| 65F11 | | $V_L$3 | | |

TABLE 3B-continued

Exemplary CDRL Sequences

| Clone | SEQ ID NO: | Contained in Reference | Designation | Amino Acid Sequence |
|---|---|---|---|---|
| 67G7 | | $V_L$3 | | |
| 63H11 | | $V_L$3 | | |
| 63B6 | 928 | $V_L$4 | CDRL2-35 | GAFSRAT |
| 64D4 | | $V_L$4 | | |
| 65C1 | | $V_L$16 | | |
| 66F6 | | $V_L$15 | | |
| 48G4 | | $V_L$89 | | |
| 53C3.1 | | $V_L$89 | | |
| 65C3 | 929 | $V_L$5 | CDRL2-36 | GASNRAI |
| 68D5 | | $V_L$5 | | |
| 64H5 | 930 | $V_L$8 | CDRL2-37 | RDSKRPS |
| 65G4 | | $V_L$8 | | |
| 67G8 | | $V_L$28 | | |
| 64H6 | | $V_L$37 | | |
| 67G10 v1 | 931 | $V_L$9 | CDRL2-38 | SDSNRPS |
| 65H11 | | $V_L$23 | | |
| 67G10 v2 | 932 | $V_L$10 | CDRL2-39 | QDNERPS |
| 66B4 | 933 | $V_L$11 | CDRL2-40 | AASSLKS |
| 66G2 | 934 | $V_L$12 | CDRL2-41 | AASNLQS |
| 68G5 | 935 | $V_L$13 | CDRL2-42 | RDRNRPS |
| 65E3 | | $V_L$25 | | |
| 65D4 | | $V_L$26 | | |
| 65B1 | 936 | $V_L$19 | CDRL2-43 | TTSSLQS |
| 53C3.2 | 937 | $V_L$96 | CDRL2-44 | GTSIRAS |
| 63A10v1 | 938 | $V_L$22 | CDRL2-45 | CDSNRPS |
| 63A10v2 | | $V_L$101 | | |
| 54H10.3 | 939 | $V_L$97 | CDRL2-46 | SASSLQS |
| 64C8 | 940 | $V_L$24 | CDRL2-47 | KGSNWDS |
| 64A6 | 941 | $V_L$30 | CDRL2-48 | GTSTRAT |
| 67F5 | 942 | $V_L$32 | CDRL2-49 | GSSNRAI |
| 64B10 | 943 | $V_L$33 | CDRL2-50 | DNDKRPS |
| 63F9 | 944 | $V_L$38 | CDRL2-51 | ASSSLQS |
| 67F6 | 945 | $V_L$39 | CDRL2-52 | TLSFRAS |
| 67F6v2 | | | | |
| 50D4 | 946 | $V_L$92 | CDRL2-53 | AASTLLS |
| 63A10v3 | 1878 | $V_L$102 | CDRL2-54 | QDSERPS |
| 48C9 | 947 | $V_L$78 | CDRL3-1 | QQSDSIPRT |
| 49A12 | | | | |
| 51E2 | | | | |
| 48F3 | 948 | $V_L$77 | CDRL3-2 | QQSYSATFT |
| 48F8 | 949 | $V_L$49 | CDRL3-3 | HQSSDLPLT |
| 53B9 | | $V_L$49 | | |
| 56B4 | | $V_L$49 | | |
| 57E7 | | $V_L$49 | | |
| 57F11 | | $V_L$49 | | |
| 48H11 | 950 | $V_L$40 | CDRL3-4 | QQSYNTPCS |
| 49A10 | 951 | $V_L$65 | CDRL3-5 | MQRIEFPIT |
| 48D4 | | $V_L$65 | | |
| 67C10 | | $V_L$36 | | |
| 67F6v1 | | $V_L$39 | | |
| 67F6v1 | | $V_L$39 | | |
| 49C8 | 952 | $V_L$45 | CDRL3-6 | QQYDNLPFT |
| 52H1 | | $V_L$45 | | |
| 49G2 | 953 | $V_L$66 | CDRL3-7 | MQHIEFPST |
| 50C12 | | $V_L$66 | | |
| 55G11 | | $V_L$66 | | |
| 49G3 | 954 | $V_L$47 | CDRL3-8 | HQYDDLPLT |
| 49H12 | 955 | $V_L$43 | CDRL3-9 | QQYDNLPLT |
| 54A1 | | $V_L$44 | | |
| 55G9 | | $V_L$44 | | |
| 51A8 | 956 | $V_L$61 | CDRL3-10 | QSYDRNNHVV |
| 51C10.1 | 957 | $V_L$55 | CDRL3-11 | YSTDSSVNHVV |
| 51C10.2 | 958 | $V_L$70 | CDRL3-12 | QAWDSGTVV |
| 51E5 | 959 | $V_L$79 | CDRL3-13 | LQHSSYPLT |
| 51G2 | 960 | $V_L$51 | CDRL3-14 | QQTNSFPPWT |
| 56A7 | | $V_L$52 | | |
| 56E4 | | $V_L$52 | | |
| 59A10 | | $V_L$48 | | |
| 49H4 | | $V_L$48 | | |
| 59C9 | | $V_L$50 | | |
| 58A5 | | $V_L$50 | | |
| 57A4 | | $V_L$50 | | |
| 57F9 | | $V_L$50 | | |
| 52A8 | 961 | $V_L$41 | CDRL3-15 | QQSYSTPLT |
| 65B1 | | $V_L$19 | | |
| 52B8 | 962 | $V_L$82 | CDRL3-16 | QQYNNWPLT |
| 56G3.2 | | $V_L$85 | | |
| 52C1 | 963 | $V_L$67 | CDRL3-17 | GTWDSSLSAVV |
| 64B10 | | $V_L$33 | | |
| 68C8 | | $V_L$34 | | |
| 52C5 | 964 | $V_L$73 | CDRL3-18 | QQSSSIPWT |
| 55E4 | | $V_L$75 | | |
| 49B11 | | $V_L$75 | | |
| 50H10 | | $V_L$75 | | |
| 53C1 | | $V_L$75 | | |
| 51C1 | | $V_L$95 | | |
| 60G5.1 | | $V_L$74 | | |
| 52F8 | 965 | $V_L$42 | CDRL3-19 | MQALQTPFT |
| 52H2 | 966 | $V_L$84 | CDRL3-20 | QQYGSSPRS |
| 53F6 | 967 | $V_L$63 | CDRL3-21 | MQGLQTPPT |
| 53H5.2 | 968 | $V_L$62 | CDRL3-22 | LQHKSYPFT |
| 53H5.3 | 969 | $V_L$80 | CDRL3-23 | QQFSNSIT |
| 54H10.1 | 970 | $V_L$53 | CDRL3-24 | QQYGSSRT |
| 55D1 | | $V_L$53 | | |
| 48H3 | | $V_L$53 | | |
| 53C11 | | $V_L$53 | | |
| 55D3 | 971 | $V_L$71 | CDRL3-25 | QQYNIYPRT |
| 55E9 | 972 | $V_L$68 | CDRL3-26 | MQALQTLIT |
| 55G5 | 973 | $V_L$83 | CDRL3-27 | QAWDSATVI |

TABLE 3B-continued

Exemplary CDRL Sequences

| Clone | SEQ ID NO: | Contained in Reference | Designation | Amino Acid Sequence |
|---|---|---|---|---|
| 56C11 | 974 | $V_L 64$ | CDRL3-28 | QVWDSSSDVV |
| 56E7 | 975 | $V_L 86$ | CDRL3-29 | QQYAILPFT |
| 56G1 | 976 | $V_L 76$ | CDRL3-30 | QQSSTIPWT |
| 56G3.3 | 977 | $V_L 81$ | CDRL3-31 | QQYGRSLFT |
| 55B10 | | $V_L 81$ | | |
| 61H5 | | $V_L 88$ | | |
| 52B9 | | $V_L 88$ | | |
| 57B12 | 978 | $V_L 72$ | CDRL3-32 | QQYNTYPRT |
| 57D9 | 979 | $V_L 87$ | CDRL3-33 | HQYGTSPCS |
| 59D10 v1 | 980 | $V_L 56$ | CDRL3-34 | YSTDSSGNHVV |
| 59D10 v2 | 981 | $V_L 57$ | CDRL3-35 | QAWDSSTAV |
| 59G10.2 | 982 | $V_L 60$ | CDRL3-36 | QAWDSSTTWV |
| 59G10.3 | 983 | $V_L 54$ | CDRL3-37 | GTWDSSLSVMV |
| 60D7 | 984 | $V_L 69$ | CDRL3-38 | MQRIEFPLT |
| 50G1 | | $V_L 90$ | | |
| 60F9 | 985 | $V_L 58$ | CDRL3-39 | QQYGSSPPWT |
| 48B4 | | $V_L 58$ | | |
| 52D6 | | $V_L 58$ | | |
| 61G5 | | $V_L 59$ | | |
| 60G5.2 | 986 | $V_L 46$ | CDRL3-40 | QAWDSSTWV |
| 63G8v1 | 987 | $V_L 1$ | CDRL3-41 | LQHNSYPLT |
| 63G8v2 | | $V_L 1$ | | |
| 64A8 | | $V_L 1$ | | |
| 67B4 | | $V_L 1$ | | |
| 68D3 | | $V_L 2$ | | |
| 64E6 | 988 | $V_L 3$ | CDRL3-42 | QQFGSSLT |
| 65E8 | | $V_L 3$ | | |
| 65F11 | | $V_L 3$ | | |
| 67G7 | | $V_L 3$ | | |
| 63H11 | | $V_L 3$ | | |
| 63F5 | | $V_L 14$ | | |
| 65C1 | | $V_L 16$ | | |
| 66F6 | | $V_L 15$ | | |
| 63B6 | 989 | $V_L 4$ | CDRL3-43 | QQFGRSFT |
| 64D4 | | $V_L 4$ | | |
| 65C3 | 990 | $V_L 5$ | CDRL3-44 | QQYNNWPWT |
| 68D5 | | $V_L 5$ | | |
| 63E6 | 991 | $V_L 6$ | CDRL3-45 | QQSYSTSLT |
| 66F7 | | $V_L 7$ | | |
| 64H5 | 992 | $V_L 8$ | CDRL3-46 | QVWDSSSVV |
| 65G4 | | $V_L 8$ | | |
| 67G10 v1 | 993 | $V_L 9$ | CDRL3-47 | QVWDSSSDGV |
| 67G10 v2 | 994 | $V_L 10$ | CDRL3-48 | QAWDSSTTVV |
| 64A10v3 | | | | |
| 64A7 | 995 | $V_L 17$ | CDRL3-49 | QQYGSSSLCS |
| 66B4 | 996 | $V_L 11$ | CDRL3-50 | QQANSFPPT |
| 66G2 | 997 | $V_L 12$ | CDRL3-51 | LQLNGYPLT |
| 68G5 | 998 | $V_L 13$ | CDRL3-52 | QLWDSSTVV |
| 66D4 | 999 | $V_L 18$ | CDRL3-53 | QQSYSSPLT |
| 54H10.3 | | $V_L 97$ | | |
| 55A7 | 1000 | $V_L 98$ | CDRL3-54 | QQTYSAPFT |
| 67A4 | 1001 | $V_L 20$ | CDRL3-55 | QVWDSSSDHVV |
| 65B4 | | $V_L 21$ | | |
| 63A10 | 1002 | $V_L 22$ | CDRL3-56 | HACGSSSSDGV |
| 65H11 | 1003 | $V_L 23$ | CDRL3-57 | QVWDSSCDGV |
| 64C8 | 1004 | $V_L 24$ | CDRL3-58 | IQDTHWPTCS |
| 65E3 | 1005 | $V_L 25$ | CDRL3-59 | QVWDSSTVV |
| 67G8 | | $V_L 28$ | | |
| 65D4 | 1006 | $V_L 26$ | CDRL3-60 | QVWDSNPVV |
| 65D1 | 1007 | $V_L 27$ | CDRL3-61 | QAWDSRV |
| 65B7v1 | 1008 | $V_L 29$ | CDRL3-62 | QQYGSSCS |
| 64A6 | 1009 | $V_L 30$ | CDRL3-63 | QQYNTWPWT |
| 65F9 | | $V_L 31$ | | |
| 67F5 | 1010 | $V_L 32$ | CDRL3-64 | QQYEIWPWT |
| 55E6 | 1011 | $V_L 99$ | CDRL3-65 | QQYGSSPWT |
| 67A5 | 1012 | $V_L 35$ | CDRL3-66 | MQRLEFPIT |
| 58C2 | | $V_L 91$ | | |
| 61E1 | 1013 | $V_L 100$ | CDRL3-67 | QQSFSTPLT |
| 64H6 | 1014 | $V_L 37$ | CDRL3-68 | QVWDSSPVV |
| 63F9 | 1015 | $V_L 38$ | CDRL3-69 | LQRNSYPLT |
| 53C3.2 | 1016 | $V_L 96$ | CDRL3-70 | HQYTNWPRT |
| 48G4 | 1017 | $V_L 89$ | CDRL3-71 | QQYGTSPFT |
| 53C3.1 | | $V_L 89$ | | |
| 50G5 v1 | 1018 | $V_L 93$ | CDRL3-72 | LQHNSYPRT |
| 50D4 | 1019 | $V_L 92$ | CDRL3-74 | QKYYSAPFT |
| 50G5 v2 | 1020 | $V_L 94$ | CDRL3-75 | MEGTHWPRD |

TABLE 3B-continued

Exemplary CDRL Sequences

| Clone | SEQ ID NO: | Contained in Reference | Designation | Amino Acid Sequence |
|---|---|---|---|---|
| 63G8v3 | 1879 | $V_L$106 | CDRL3-76 | LQHNTYPLT |
| 65B7v2 | 1880 | $V_L$107 | CDRL3-77 | MQGTHWRGWT |
| 65H11v2 | 1881 | $V_L$103 | CDRL3-78 | QAWDSITVV |
| 63A10v1 | 1882 | $V_L$22 | CDRL3-79 | QVWDSSSDGV |

TABLE 3C

Coding Sequences for CDRHs

| Clone | SEQ ID NO: | Contained in Reference | Designation | Coding Sequences |
|---|---|---|---|---|
| 48C9 | 1021 | $V_H$73 | CDRH1-1 | GGTTACTACTGGACC |
| 49A12 | | $V_H$73 | | |
| 51E2 | | $V_H$73 | | |
| 48F3 | 1022 | $V_H$72 | CDRH1-2 | GGTTACTACTGGAGC |
| 51E5 | | $V_H$74 | | |
| 52C5 | | $V_H$70 | | |
| 55E4 | | $V_H$70 | | |
| 60G50.1 | | $V_H$70 | | |
| 49B11 | | $V_H$70 | | |
| 50H10 | | $V_H$70 | | |
| 53C1 | | $V_H$70 | | |
| 56G1 | | $V_H$71 | | |
| 51C1 | | $V_H$89 | | |
| 48F8 | 1023 | $V_H$48 | CDRH1-3 | AGCTATAGCATGAAC |
| 51G2 | | $V_H$50 | | |
| 56A7 | | $V_H$51 | | |
| 53B9 | | $V_H$48 | | |
| 56B4 | | $V_H$48 | | |
| 57E7 | | $V_H$48 | | |
| 57F11 | | $V_H$48 | | |
| 56E4 | | $V_H$51 | | |
| 55E6 | | $V_H$93 | | |
| 48H11 | 1024 | $V_H$39 | CDRH1-4 | GGCTACTATAAGCAC |
| 48G4 | 1025 | $V_H$83 | CDRH1-5 | GAATTATCCATACAC |
| 49A10 | 1026 | $V_H$62 | CDRH1-6 | AACTATGGCATGCAC |
| 58C2 | | $V_H$85 | | |
| 59G10.2 | | $V_H$57 | | |
| 48D4 | | $V_H$62 | | |
| 49C8 | 1027 | $V_H$44 | CDRH1-7 | AGTTATGATATCGAC |
| 52H1 | | | | |
| 49G2 | 1028 | $V_H$63 | CDRH1-8 | AACTATGGCATGCGC |
| 50C12 | | $V_H$63 | | |
| 55G11 | | $V_H$63 | | |
| 49G3 | 1029 | $V_H$46 | CDRH1-9 | AATCCTAGAATGGGTGTGAGC |
| 49H12 | 1030 | $V_H$42 | CDRH1-10 | AGTTACGATATCAAC |
| 54A1 | | $V_H$43 | | |
| 55G9 | | $V_H$43 | | |
| 50G1 | 1031 | $V_H$84 | CDRH1-11 | AGCTATGGCCTGCAC |
| 51A8 | 1032 | $V_H$58 | CDRH1-12 | AGCTATGGCATGCAC |
| 52C1 | | $V_H$64 | | |
| 53H5.2 | | $V_H$59 | | |
| 56C11 | | $V_H$61 | | |
| 60D7 | | $V_H$66 | | |
| 64H5 | | $V_H$7 | | |
| 65G4 | | $V_H$8 | | |
| 66G2 | | $V_H$11 | | |
| 68G5 | | $V_H$12 | | |
| 64C8 | | $V_H$23 | | |
| 67G8 | | $V_H$27 | | |
| 68D3v2 | | $V_H$8 | | |

TABLE 3C-continued

Coding Sequences for CDRHs

| Clone | SEQ ID NO: | Contained in Reference | Designation | Coding Sequences |
|---|---|---|---|---|
| 51C10.1 | 1033 | $V_H54$ | CDRH1-13 | AACTATGCCATGAGC |
| 59D10v1 | | $V_H54$ | | |
| 59D10v2 | | $V_H54$ | | |
| 51C10.2 | 1034 | $V_H67$ | CDRH1-14 | AGTGGTGGTTACTACTGGAGC |
| 64A6 | | $V_H29$ | | |
| 52A8 | 1035 | $V_H40$ | CDRH1-15 | GGCTACTATTTGCAC |
| 66B4 | | $V_H10$ | | |
| 52B8 | 1036 | $V_H77$ | CDRH1-16 | TATTATTACTGGAGT |
| 52F8 | 1037 | $V_H41$ | CDRH1-17 | GGCTACTATACACAC |
| 52H2 | 1038 | $V_H79$ | CDRH1-18 | ACTTACTACTGGAGC |
| 53F6 | 1039 | $V_H60$ | CDRH1-19 | ACCTATGGCATGCAC |
| 53H5.3 | 1040 | $V_H75$ | CDRH1-20 | GATTACTACTGGAAC |
| 54H10.1 | 1041 | $V_H52$ | CDRH1-21 | AGCTATGCCATGAGC |
| 60F9 | | $V_H55$ | | |
| 61G5 | | $V_H56$ | | |
| 55D1 | | $V_H52$ | | |
| 48H3 | | $V_H52$ | | |
| 53C11 | | $V_H52$ | | |
| 48B4 | | $V_H55$ | | |
| 52D6 | | $V_H55$ | | |
| 55D3 | 1042 | $V_H68$ | CDRH1-22 | AGTGGTGTTTACTACTGGAAC |
| 55E9 | 1043 | $V_H65$ | CDRH1-23 | AGCTTTGGCATGCAC |
| 55G5 | 1044 | $V_H78$ | CDRH1-24 | AGTTACTACTGGAGC |
| 65C3 | | $V_H5$ | | |
| 68D5 | | $V_H5$ | | |
| 67F5 | | $V_H31$ | | |
| 55A7 | | $V_H92$ | | |
| 56E7 | 1045 | $V_H81$ | CDRH1-25 | AGCTACTGGATCGGC |
| 67A5 | | $V_H34$ | | |
| 67C10 | | $V_H35$ | | |
| 64H6 | | $V_H36$ | | |
| 56G3.2 | 1046 | $V_H80$ | CDRH1-26 | AGTTACTACTGGAAC |
| 56G3.3 | 1047 | $V_H76$ | CDRH1-27 | AGTAGTAGTTACTACTGGGGC |
| 55B10 | | $V_H76$ | | |
| 61H5 | | $V_H86$ | | |
| 52B9 | | $V_H86$ | | |
| 57B12 | 1048 | $V_H69$ | CDRH1-28 | AGTGGTGTTTACTACTGGAGC |
| 57D9 | 1049 | $V_H82$ | CDRH1-29 | AGCAACAGTGCTACTTGGAAC |
| 59A10 | 1050 | $V_H47$ | CDRH1-30 | GACTCCTACATGAGC |
| 49H4 | | | | |
| 59C9 | 1051 | $V_H49$ | CDRH1-31 | AGCTATAGCATGAGT |
| 58A5 | | $V_H49$ | | |
| 57A4 | | $V_H49$ | | |
| 57F9 | | $V_H49$ | | |
| 59G10.3 | 1052 | $V_H53$ | CDRH1-32 | CACTATGCCATGAGC |
| 60G5.2 | 1053 | $V_H45$ | CDRH1-33 | AACTATGGTATCAGC |
| 63G8 | 1054 | $V_H1$ | CDRH1-34 | AGCTATGGCATACAC |
| 64A8 | | $V_H1$ | | |
| 67B4 | | $V_H1$ | | |
| 68D3 | | $V_H1$ | | |

TABLE 3C-continued

Coding Sequences for CDRHs

| Clone | SEQ ID NO: | Contained in Reference | Designation | Coding Sequences |
|---|---|---|---|---|
| 64E6 | 1055 | $V_H2$ | CDRH1-35 | AGTGGTGATTACTACTGGACC |
| 65E8 | | $V_H2$ | | |
| 65F11 | | $V_H2$ | | |
| 67G7 | | $V_H2$ | | |
| 63H11 | | $V_H3$ | | |
| 63F5 | | $V_H13$ | | |
| 65C1 | | $V_H15$ | | |
| 66F6 | | $V_H14$ | | |
| 63B6 | 1056 | $V_H4$ | CDRH1-36 | AGTGGTGATTACTACTGGAGC |
| 64D4 | | $V_H4$ | | |
| 65F9 | | $V_H30$ | | |
| 64B10v1 | | $V_H32$ | | |
| 64B10v1 | | $V_H32$ | | |
| 63E6 | 1057 | $V_H6$ | CDRH1-37 | AGTGGTGATTACTACTGGACC |
| 66F7 | | $V_H6$ | | |
| 50G5 v1 | | $V_H88$ | | |
| 50G5 v2 | | $V_H88$ | | |
| 67G10v1 | 1058 | $V_H9$ | CDRH1-38 | AACGCCTGGATGAGT |
| 67G10v2 | | $V_H9$ | | |
| 63A10 | | $V_H21$ | | |
| 65H11 | | $V_H22$ | | |
| 53C3.2 | 1059 | $V_H90$ | CDRH1-39 | AGTGGTAATTACTACTGGAGC |
| 64A7 | 1060 | $V_H16$ | CDRH1-40 | AGTGATACTTCCTACTGGGGC |
| 50D4 | 1061 | $V_H87$ | CDRH1-41 | AGTCATGATATCAAC |
| 61E1 | 1062 | $V_H94$ | CDRH1-42 | AGCAACAGTGCTGCTTGGAAC |
| 66D4 | 1063 | $V_H17$ | CDRH1-43 | GGCTACTATATACAC |
| 54H10.3 | | $V_H91$ | | |
| 65B1 | 1064 | $V_H18$ | CDRH1-44 | GGCTACTTTATGCAC |
| 67A4 | 1065 | $V_H19$ | CDRH1-45 | ACCTACGACATGCAC |
| 65B4 | 1066 | $V_H20$ | CDRH1-46 | AGTTACGACATGCAC |
| 65E3 | 1067 | $V_H24$ | CDRH1-47 | AACTATAACATGCAC |
| 65D4 | 1068 | $V_H25$ | CDRH1-48 | TTCTATGGCATGCAC |
| 65D1 | 1069 | $V_H26$ | CDRH1-49 | TACTATTACATTCAC |
| 65B7 | 1070 | $V_H28$ | CDRH1-50 | AGTGATGCTTACTACTGGAGC |
| 68C8 | 1071 | $V_H33$ | CDRH1-51 | AGTGGTGATAACTACTGGAGC |
| 63F9 | 1072 | $V_H37$ | CDRH1-52 | AGTGGTGGTTACTACTGGAAC |
| 67F6 | 1073 | $V_H38$ | CDRH1-53 | GGCTACTGGATCGGC |
| 48C9 | 1074 | $V_H73$ | CDRH2-1 | GAAATCAATCATAGTGAAAACACCAACT |
| 52C5 | | $V_H70$ | | ACAACCCGTCCCTCAAGAGT |
| 55E4 | | $V_H70$ | | |
| 56G1 | | $V_H71$ | | |
| 49A12 | | $V_H73$ | | |
| 51E2 | | $V_H73$ | | |
| 60G5.1 | | $V_H70$ | | |
| 49B11 | | $V_H70$ | | |
| 50H10 | | $V_H70$ | | |
| 53C1 | | $V_H70$ | | |
| 51C1 | | $V_H89$ | | |
| 48F3 | 1075 | $V_H72$ | CDRH2-2 | GAAATCACTCATACTGGAAGCTCCAACT |
| | | | | ACAACCCGTCCCTCAAGAGT |

TABLE 3C-continued

Coding Sequences for CDRHs

| Clone | SEQ ID NO: | Contained in Reference | Designation | Coding Sequences |
|---|---|---|---|---|
| 48F8 | 1076 | $V_H48$ | CDRH2-3 | TCCATTAGTAGTAGTAGTTACGAATA |
| 53B9 | | $V_H48$ | | CTACGTAGACTCAGTGAAGGGC |
| 56B4 | | $V_H48$ | | |
| 57E7 | | $V_H48$ | | |
| 57F11 | | $V_H48$ | | |
| 48H11 | 1077 | $V_H39$ | CDRH2-4 | TGGATCAACCCTAACAGTGGTGCCACAA |
| | | | | AGTATGCACAGAAGTTTCAGGGC |
| 48G4 | 1078 | $V_H83$ | CDRH2-5 | GGTTTTGATCCTGAAGATGGTGAAACAA |
| 53C3.1 | | | | TCTACGCACAGAAGTTCCAGGGC |
| 49A10 | 1079 | $V_H62$ | CDRH2-6 | ATTATATGGTATGATGGAAGTAATAAAA |
| 48D4 | | $V_H62$ | | ACTATGCAGACTCCGTGAAGGGC |
| 49C8 | 1080 | $V_H44$ | CDRH2-7 | TGGATGAACCCTAACGGTGGTAACACAG |
| | | | | GCTATGCACAGAAGTTCCAGGGC |
| 49G2 | 1081 | $V_H63$ | CDRH2-8 | CTTATATGGTATGATGGAAGTAATAAGTT |
| 50C12 | | $V_H63$ | | CTATGCAGACTCCGTGAAGGGC |
| 55G11 | | $V_H63$ | | |
| 49G3 | 1082 | $V_H46$ | CDRH2-9 | CACATTTTTTCGAATGACGAAAAATCCTA |
| | | | | CAGCACATCTCTGAAGAGC |
| 49H12 | 1083 | $V_H42$ | CDRH2-10 | TGGATGAACCCCTACAGTGGGAGCACAG |
| | | | | GCTATGCACAGAATTTCCAGGGC |
| 50G1 | 1084 | $V_H84$ | CDRH2-11 | GTTATATGGAATGATGGAAGTAATAAGC |
| | | | | TTTATGCAGACTCCGTGAAGGGC |
| 51A8 | 1085 | $V_H58$ | CDRH2-12 | GTTATATCATATGATGGAAGTAATAAAT |
| 63G8 | | $V_H1$ | | ACTATGCAGACTCCGTGAAGGGC |
| 64A8 | | $V_H1$ | | |
| 67B4 | | $V_H1$ | | |
| 68D3 | | $V_H1$ | | |
| 51C10.1 | 1086 | $V_H54$ | CDRH2-13 | GGTATTAGTGGTAGTAGTGCTGGCACAT |
| 59D10v1 | | $V_H54$ | | ACTACGCAGACTCCGTGAAGGGC |
| 59D10v2 | | $V_H54$ | | |
| 51C10.2 | 1087 | $V_H67$ | CDRH2-14 | TACATCTATTACAATGGGAGTCCCTACGA |
| | | | | CAACCCGTCCCTCAAGAGG |
| 51E5 | 1088 | $V_H74$ | CDRH2-15 | GAACTCGATCATAGTGGAAGTATCAACT |
| | | | | ACAACCCGTCCCTCAAGAGT |
| 51G2 | 1089 | $V_H50$ | CDRH2-16 | TCCATTAGTAGTAGTAGTACTTACATATA |
| 56A7 | | $V_H51$ | | CTACGCAGACTCAGTGAAGGGC |
| 56E4 | | $V_H51$ | | |
| 52A8 | 1090 | $V_H40$ | CDRH2-17 | TGGATCAACCCTAACAGTGCTGCCACAA |
| | | | | ACTATGCACCGAAGTTTCAGGGC |
| 52B8 | 1091 | $V_H77$ | CDRH2-18 | TATATCTATTATAGTGGGAGCACCAACTA |
| 55A7 | | $V_H92$ | | CAACCCCTCCCTCAAGAGT |
| 52C1 | 1092 | $V_H64$ | CDRH2-19 | GTTATATGGTATGATGGAAGTAATAACT |
| | | | | ATTATGCAGACTCCGTGAAGGGC |
| 52F8 | 1093 | $V_H41$ | CDRH2-20 | TGGATCAACCCTAGCAGTGGTGACACAA |
| | | | | AGTATGCACAGAAGTTTCAGGGC |
| 52H2 | 1094 | $V_H79$ | CDRH2-21 | TATATCTTTTACAATGGGAACGCCAACTA |
| | | | | CAGCCCCTCCCTGAAGAGT |
| 53F6 | 1095 | $V_H60$ | CDRH2-22 | GTTATATGGTATGATGGAAGTAATAAAT |
| 60D7 | | $V_H66$ | | ACTATGCAGACTCCGTGAAGGGC |
| 65D4 | | $V_H25$ | | |
| 53H5.2 | 1096 | $V_H59$ | CDRH2-23 | CTTATATCATATGATGGAAGTAATAAATA |
| | | | | CTATGCAGACTCCGTGAAGGGC |

TABLE 3C-continued

Coding Sequences for CDRHs

| Clone | SEQ ID NO: | Contained in Reference | Designation | Coding Sequences |
|---|---|---|---|---|
| 53H5.3 | 1097 | $V_H75$ | CDRH2-24 | GAAATCAATCATAGTGGAACCACCAACT ACAATCCGTCCCTCAAGAGT |
| 54A1<br>55G9 | 1098 | $V_H43$<br>$V_H43$ | CDRH2-25 | TGGATGAACCCTCACAGTGGTAACACAG GCTATGCACAGAAGTTCCAGGGC |
| 54H10.1<br>55D1<br>48H3<br>53C11 | 1099 | $V_H52$<br>$V_H52$<br>$V_H52$<br>$V_H52$ | CDRH2-26 | GCTATTAGTGGTAGTGGTCGTACCACATA CTCCGCAGACTCCGTGAAGGGC |
| 55D3 | 1100 | $V_H68$ | CDRH2-27 | TACCTCTATTACAGTGGGAGCACCTACTA CAACCCGTCCCTCAAGAGT |
| 55E9 | 1101 | $V_H65$ | CDRH2-28 | CTTATATGGTATGATGGAGATAATAAAT ACTATGCAGACTCCGTGAAGGGC |
| 55G5 | 1102 | $V_H78$ | CDRH2-29 | CGTATCTATATCAGTGGGAGCACCAACT ACAACCCCTCCCTCGAGAAT |
| 56C11 | 1103 | $V_H61$ | CDRH2-30 | GTTATATGGTATGATGGAAGTTATCAATT CTATGCAGACTCCGTGAAGGGC |
| 56E7<br>67A5<br>67C10<br>67F6 | 1104 | $V_H81$<br>$V_H34$<br>$V_H35$<br>$V_H38$ | CDRH2-31 | ATCATCTATCCTGGTGACTCTGATACCAG ATACAGCCCGTCCTTCCAAGGC |
| 56G3.2 | 1105 | $V_H80$ | CDRH2-32 | CGTATCTATACCAGTGGGAGCACCAACT ACAATCCCTCCCTCAAGAGT |
| 56G3.3 | 1106 | $V_H76$ | CDRH2-33 | ATGATCTATTATAGTGGGACCACCTACTA CAACCCGTCCCTCAAGAGT |
| 57B12<br>63H11<br>66F6<br>65F9 | 1107 | $V_H69$<br>$V_H3$<br>$V_H14$<br>$V_H30$ | CDRH2-34 | TACATCTATTACAGTGGGAGCACCTACTA CAACCCGTCCCTCAAGAGT |
| 57D9<br>61E1 | 1108 | $V_H82$<br>$V_H94$ | CDRH2-35 | AGGACATACTACAGGTCCAAGTGGTATA ATGATTATGCAGTATCTGTGAAAAGT |
| 58C2 | 1109 | $V_H85$ | CDRH2-36 | GTTATATGGAATGATGGAAATAACAAAT ACTATGCAGACTCCGTGAAGGGC |
| 59A10<br>49H4 | 1110 | $V_H47$ | CDRH2-37 | TCCATTAGTAGTAGTGGTAGTATCGTATA CTTCGCAGACTCTGTGAAGGGC |
| 59C9<br>58A5<br>57A4<br>57F9 | 1111 | $V_H49$<br>$V_H49$<br>$V_H49$<br>$V_H49$ | CDRH2-38 | TCCATTAGTAGTAGTAGTACTTACATATA CTACGCAGACTCACTGAAGGGC |
| 59G10.2 | 1112 | $V_H57$ | CDRH2-39 | ATTACATCATATGGAGGAAGTAATAAAA ATTATGCAGACTCCGTGAAGGGC |
| 59G10.3 | 1113 | $V_H53$ | CDRH2-40 | GCTATTAGTGGTAGTGGTGCTGGCACATT CTACGCGGACTCCATGAAGGGC |
| 60F9<br>48B4<br>52D6 | 1114 | $V_H55$<br>$V_H55$<br>$V_H55$ | CDRH2-41 | GTTATTAGTGACAGTGGTGGTAGCACAT ACTACGCAGACTCCGTGAAGGGC |
| 60G5.2 | 1115 | $V_H45$ | CDRH2-42 | TGGATCAGCGCTTACAATGGTTACTCAAA CTATGCACAGAAGTTCCAGGAC |
| 61G5 | 1116 | $V_H56$ | CDRH2-43 | GTTATTAGTGGTAGTGGTGGTGACACATA CTACGCAGACTCCGTGAAGGGC |
| 64E6<br>65E8<br>65F11<br>67G7 | 1117 | $V_H2$<br>$V_H2$<br>$V_H2$<br>$V_H2$ | CDRH2-44 | TACATCTATTACACTGGGAGCACCTACTA CAACCCGTCCCTCAAGAGT |

TABLE 3C-continued

Coding Sequences for CDRHs

| Clone | SEQ ID NO: | Contained in Reference | Designation | Coding Sequences |
|---|---|---|---|---|
| 63B6 64D4 | 1118 | $V_H4$ $V_H4$ | CDRH2-45 | TACATCTATTACAGTGGGACCACCTACTA CAACCCGTCCCTCAAGAGT |
| 65C3 68D5 | 1119 | $V_H5$ $V_H5$ | CDRH2-46 | TATATCTATTACACTGGGAGCACCAACTA CAACCCCTCCCTCAAGAGT |
| 63E6 66F7 | 1120 | $V_H6$ $V_H6$ | CDRH2-47 | TGGATGAACCCTAATAGTGGTGCCACAA AGTATGCACAGAAGTTTCAGGGC |
| 64H5 65G4 | 1121 | $V_H7$ $V_H8$ | CDRH2-48 | GTTATATGGGATGATGGAAGTAATAAAT ACTATGCAGACTCCGTGAAGGGC |
| 67G10v1 67G10v2 | 1122 | $V_H9$ $V_H9$ | CDRH2-49 | CGTATTAAAAGCAAAACTGATGGTGGGA CAACAGAGTACGCTGCACCCGTGAAAGGC |
| 63F5 | 1123 | $V_H13$ | CDRH2-50 | TACATCTATTACAGTGGGAGCGCCTACTA CAACCCGTCCCTCAAGAGT |
| 64A7 | 1124 | $V_H16$ | CDRH2-51 | AATATCTATTATAGTGGGACCACCTACTT CAACCCGTCCCTCAAGAGT |
| 65C1 65B7 | 1125 | $V_H15$ $V_H28$ | CDRH2-52 | TACATTTTTTACAGTGGGAGCACCTACTA CAACCCGTCCCTCAAGAGT |
| 66B4 | 1126 | $V_H10$ | CDRH2-53 | TGGATCAACCCTAACAGTGGTGGCACAG ACTATGCACAGAAGTTTCAGGGC |
| 66G2 | 1127 | $V_H11$ | CDRH2-54 | GGTATATCATATGATGAAGTAATAAAA ACTATGCAGACTCCGTGAAGGGC |
| 68G5 | 1128 | $V_H12$ | CDRH2-55 | GTTATATGGTATGATGGAAGTAATAAAT ACCATGCAGACTCCGTGAAGGGC |
| 66D4 | 1129 | $V_H17$ | CDRH2-56 | TGGATCAACCCTCCCAGTGGTGCCACAA ACTATGCACAGAAGTTTCGGGGC |
| 65B1 | 1130 | $V_H18$ | CDRH2-57 | TGGATCAACCCTAACAGTGGTGCCACAA ACTATGCACAGAAGTTTCACGGC |
| 67A4 | 1131 | $V_H19$ | CDRH2-58 | GCTATTGGTATTGCTGGTGACACATACTA TTCAGACTCCGTGAAGGGC |
| 65B4 | 1132 | $V_H20$ | CDRH2-59 | ACTATTGATACTGCTGGTGACGCTTACTA TCCAGGCTCCGTGAAGGGC |
| 63A10 67G10v1 67G10v2 | 1133 | $V_H21$ $V_H9$ $V_H9$ | CDRH2-60 | CGTATTAAAAGCAAAACTGATGGTGGGA CAACAGACTACGCTGCACCCGTGAAAGGC |
| 65H11 | 1134 | $V_H22$ | CDRH2-61 | CGTATTATAGGCAAAACTGATGGTGGGA CAACAGACTACGCTGCACCCGTGAAAGGC |
| 64C8 | 1135 | $V_H23$ | CDRH2-62 | GTTATATCATATGATGGAAGTAACAAAC ACTATGCAGACTCCGTGAAGGGC |
| 65E3 | 1136 | $V_H24$ | CDRH2-63 | GTTTTATGGTATGATGGAAATACTAAATA CTATGCAGACTCCGTGAAGGGC |
| 65D1 | 1137 | $V_H26$ | CDRH2-64 | CTTATATGGTATGATGGAAGTAATAAAG ACTATGCAGACTCCGTGAAGGGC |
| 67G8 | 1138 | $V_H27$ | CDRH2-65 | GTTATATGGTATGATGGAAGTAATAAAG ACTATGCAGACTCCGTGAAGGGC |
| 64A6 | 1139 | $V_H29$ | CDRH2-66 | TACATCTATTACAGTGGGGGCACCCACTA CAACCCGTCCCTCAAGAGT |
| 67F5 | 1140 | $V_H31$ | CDRH2-67 | TATATCTATTACAGTGGGAACACCAACTA CAACCCCTCCCTCAAGAGT |
| 64B10 | 1141 | $V_H32$ | CDRH2-68 | TTTATCTATTACAGTGGGGGCACCAACTA CAACCCCTCCCTCAAGAGT |

TABLE 3C-continued

Coding Sequences for CDRHs

| Clone | SEQ ID NO: | Contained in Reference | Designation | Coding Sequences |
|---|---|---|---|---|
| 68C8 | 1142 | $V_H33$ | CDRH2-69 | TTCATGTTTTACAGTGGGAGTACCAACTACAACCCCTCCCTCAAGAGT |
| 64H6 | 1143 | $V_H36$ | CDRH2-70 | ATCATCTATCCTGGTGACTCTGAAACCAGATACAGCCCGTCCTTTCAAGGC |
| 63F9 | 1144 | $V_H37$ | CDRH2-71 | TACATCTATGACAGTGGGAGCACCTACTACAACCCGTCCCTCAAGAGT |
| 61H5  52B9 | 1145 | $V_H86$  $V_H86$ | CDRH2-72 | AGTATCTATTATAGTGGGACCACCTACTACAACCCGTCCCTCAAGAGT |
| 50G5 v1  50G5 v2 | 1146 | $V_H88$  $V_H88$ | CDRH2-73 | TGGATCAACCCTGACAGTGGTGGCACAAACTATGCACAGAAGTTTCAGGGC |
| 54H10.3 | 1147 | $V_H91$ | CDRH2-74 | TGGATCAACCCTAACAGTGGTGGCACAAACTATGCACAGAAGTTTCGGGGC |
| 50D4 | 1148 | $V_H87$ | CDRH2-75 | TGGATGAACCCTTACAGTGGTAGCACAGGCCTCGCACAGAGGTTCCAGGAC |
| 55E6 | 1149 | $V_H93$ | CDRH2-76 | TACATTAGTAGTGGTAGTAGTACCATATACCACGCAGACTCTGTGAAGGGC |
| 53C3.2 | 1150 | $V_H90$ | CDRH2-77 | TACATCTATACAGTGGGAGCGCCTACTACAACCCGTCCCTCAAGAGT |
| 64B10v2 | 1883 | $V_H96$ | CDRH2-78 | TTTATTTATTACAGTGGGGGCACCAACTACAACCCCCCCTCAAGAGT |
| 68D3v2 | 1884 | $V_H95$ | CDRH2-79 | TTTATATCATATGCTGGAAGTAATAAATACTATGCAGACTCCGTGAAGGGC |
| 48C9  49A12  51E2 | 1151 | $V_H73$  $V_H73$  $V_H73$ | CDRH3-1 | GAGAGTGGGAACTTCCCCTTTGACTAC |
| 48F3 | 1152 | $V_H72$ | CDRH3-2 | GGCGGGATTTTATGGTTCGGGGAGCAGGCTTTTGATATC |
| 48F8  53B9  56B4  57E7  57F11 | 1153 | $V_H48$  $V_H48$  $V_H48$  $V_H48$  $V_H48$ | CDRH3-3 | TCCCTAAGTATAGCAGTGGCTGCCTCTGACTAC |
| 48H11 | 1154 | $V_H39$ | CDRH3-4 | GAGGTACCCGACGGTATAGTAGTGGCTGGTTCAAATGCTTTTGATTTC |
| 48G4  53C3.1 | 1155 | $V_H83$ | CDRH3-5 | CATTCTGGTTCGGGGAGGTTTTACTACTACTACTACGGTATGGACGTC |
| 49A10  48D4 | 1156 | $V_H62$  $V_H62$ | CDRH3-6 | GATCAGGATTACGATTTTGGAGTGGTTATCCTTACTTCTACTACTACGGTATGGACGTC |
| 49C8 | 1157 | $V_H44$ | CDRH3-7 | GGGAAGGAATTTAGCAGGGCGGAGTTTGACTAC |
| 49G2  50C12  55G11 | 1158 | $V_H63$  $V_H63$  $V_H63$ | CDRH3-8 | GATCGGTATTACGATTTTTGGAGTGGTTATCCATACTTCTTCTACTACGGTCTGGACGTC |
| 49G3 | 1159 | $V_H46$ | CDRH3-9 | GTAGATACCTTGAACTACCACTACTACGGTATGGACGTC |
| 49H12  54A1  55G9 | 1160 | $V_H42$  $V_H43$  $V_H43$ | CDRH3-10 | TATAATTGGAACTATGGGGCTTTTGATTTC |
| 50G1 | 1161 | $V_H84$ | CDRH3-11 | GATCAGTATTACGATTTTTGGAGCGGTTACCCATACTATCACTACTACGGTATGGACGTC |

TABLE 3C-continued

Coding Sequences for CDRHs

| Clone | SEQ ID NO: | Contained in Reference | Designation | Coding Sequences |
|---|---|---|---|---|
| 51A8 | 1162 | $V_H58$ | CDRH3-12 | GCGGACGGTGACTACCCATATTACTACTA CTACTACGGTATGGACGTC |
| 51C10.1 59D10 v1 59D10 v2 | 1163 | $V_H54$ $V_H54$ $V_H54$ | CDRH3-13 | GATTGGAGTATAGCAGTGGCTGGTACTTT TGACTAC |
| 51C10.2 | 1164 | $V_H67$ | CDRH3-14 | GGGGCCCTCTACGGTATGGACGTC |
| 51E5 | 1165 | $V_H74$ | CDRH3-15 | GTCCTGGGATCTACTCTTGACTAT |
| 51G2 | 1166 | $V_H50$ | CDRH3-16 | GATACTTATATCAGTGGCTGGAACTACG GTATGGACGTC |
| 52A8 | 1167 | $V_H40$ | CDRH3-17 | GAGGGTGGAACTTACAACTGGTTCGACC CC |
| 52B8 | 1168 | $V_H77$ | CDRH3-18 | GGAACTAGGGCTTTTGATATC |
| 52C1 | 1169 | $V_H64$ | CDRH3-19 | GATCGGGCGGGAGCCTCTCCCGGAATGG ACGTC |
| 52C5 60G5.1 49B11 50H10 53C1 51C1 55E4 56G1 | 1170 | $V_H70$ $V_H70$ $V_H70$ $V_H70$ $V_H70$ $V_H89$ $V_H70$ $V_H71$ | CDRH3-20 | GTAACTGGAACGGATGCTTTTGATTTC |
| 52F8 | 1171 | $V_H41$ | CDRH3-21 | AGTGGCTGGTACCCGTCCTACTACTACGG TATGGACGTC |
| 52H2 | 1172 | $V_H79$ | CDRH3-22 | GAAACGGACTACGGTGACTACGCACGTC CTTTTGAATAC |
| 53F6 | 1173 | $V_H60$ | CDRH3-23 | GGCCACTATGATAGTAGTGGTCCCAGGG ACTAC |
| 53H5.2 | 1174 | $V_H59$ | CDRH3-24 | GAGGCTAACTGGGGCTACAACTACTACG GTATGGACGTC |
| 53H5.3 | 1175 | $V_H75$ | CDRH3-25 | ATATTACGATATTTTGACTGGTTAGAATA CTACTTTGACTAC |
| 61E1 | 1176 | $V_H94$ | CDRH3-26 | GAGGGCAGCTGGTCCTCCTTCTTTGACTAC |
| 54H10.1 55D1 48H3 53C11 | 1177 | $V_H52$ $V_H52$ $V_H52$ $V_H52$ | CDRH3-27 | GAACAGCAGTGGCTGGTTTATTTTGACTAC |
| 55D3 57B12 | 1178 | $V_H68$ $V_H69$ | CDRH3-28 | GATGGTATTACTATGGTTCGGGGAGTTAC TCACTACTACGGTATGGACGTC |
| 55E6 | 1179 | $V_H93$ | CDRH3-29 | GAAGGGTACTATGATAGTAGTGGTTATT ACTACAACGGTATGGACGTC |
| 55E9 | 1180 | $V_H65$ | CDRH3-30 | AACAGTGGCTGGGATTACTTCTACTACTA CGGTATGGACGTC |
| 55G5 | 1181 | $V_H78$ | CDRH3-31 | AGTGGGAGCTACTCCTTTGACTAC |
| 56A7 56E4 | 1182 | $V_H51$ $V_H51$ | CDRH3-32 | GATATCTATAGCAGTGGCTGGAGCTACG GTATGGACGTC |
| 56C11 | 1183 | $V_H61$ | CDRH3-33 | GATCACGTTTGGAGGACTTATCGTTATAT CTTTGACTAC |
| 56E7 | 1184 | $V_H81$ | CDRH3-34 | GCACAACTGGGGATCTTTGACTAC |

TABLE 3C-continued

Coding Sequences for CDRHs

| Clone | SEQ ID NO: | Contained in Reference | Designation | Coding Sequences |
|---|---|---|---|---|
| 50G5 v1<br>50G5 v2 | 1185 | $V_H 88$<br>$V_H 88$ | CDRH3-35 | GGCGGATACAGCTATGGTTACGAGGACT<br>ACTACGGTATGGACGTC |
| 56G3.2 | 1186 | $V_H 80$ | CDRH3-36 | GGCCCTCTTTGGTTTGACTAC |
| 56G3.3<br>55B10<br>61H5<br>52B9 | 1187 | $V_H 76$<br>$V_H 76$<br>$V_H 86$<br>$V_H 86$ | CDRH3-37 | GTGGCAGCAGTTTACTGGTATTTCGATCTC |
| 55A7 | 1188 | $V_H 92$ | CDRH3-38 | GGGATAACTGGAACTATTGACTTC |
| 57D9 | 1189 | $V_H 82$ | CDRH3-39 | ATTGTAGTAGTACCAGCTGTTCTCTTTGA<br>CTAC |
| 58C2 | 1190 | $V_H 85$ | CDRH3-40 | GATCAGAATTACGATTTTGGAATGGTTA<br>TCCCTACTACTTCTACTACGGTATGGACG<br>TC |
| 59A10<br>49H4 | 1191 | $V_H 47$ | CDRH3-41 | GAGACGTTTAGCAGTGGCTGGTTCGATG<br>CTTTTGATATC |
| 59C9<br>58A5<br>57A4<br>57F9 | 1192 | $V_H 49$<br>$V_H 49$<br>$V_H 49$<br>$V_H 49$ | CDRH3-42 | GATCGATGGAGCAGTGGCTGGAACGAAG<br>GTTTTGACTAT |
| 53C3.2 | 1193 | $V_H 90$ | CDRH3-43 | ACTACGGGTGCTTCTGATATC |
| 59G10.2 | 1194 | $V_H 57$ | CDRH3-44 | GAGGCCGGGTATAGCTTTGACTAC |
| 59G10.3 | 1195 | $V_H 53$ | CDRH3-45 | GATCTTAGAATAGCAGTGGCTGGTTCATT<br>TGACTAC |
| 60D7 | 1196 | $V_H 66$ | CDRH3-46 | GATCTTAGAATAGCAGTGGCTGGTTCATT<br>TGACTAC |
| 60F9<br>48B4<br>52D6 | 1197 | $V_H 55$<br>$V_H 55$<br>$V_H 55$ | CDRH3-47 | GATCAGTATTTCGATTTTGGAGTGGTTA<br>TCCTTTCTTCTACTACTACGGTATGGACG<br>TC |
| 60G5.2 | 1198 | $V_H 45$ | CDRH3-48 | GATCATAGCAGTGGCTGGTACTACTACG<br>GTATGGACGTC |
| 61G5 | 1199 | $V_H 56$ | CDRH3-49 | GATCATACCAGTGGCTGGTACTACTACG<br>GTATGGACGTC |
| 63G8<br>64A8<br>67B4<br>68D3<br>66G2 | 1200 | $V_H 1$<br>$V_H 1$<br>$V_H 1$<br>$V_H 1$<br>$V_H 11$ | CDRH3-50 | ACGGTGACTAAGGAGGACTACTACTACT<br>ACGGTATGGACGTC |
| 64E6<br>65E8<br>65F11<br>67G7<br>63H11<br>63F5<br>66F6 | 1201 | $V_H 2$<br>$V_H 2$<br>$V_H 2$<br>$V_H 2$<br>$V_H 3$<br>$V_H 13$<br>$V_H 14$ | CDRH3-51 | ATGACTACCCCTTACTGGTACTTCGATCTC |
| 63B6<br>64D4 | 1202 | $V_H 4$<br>$V_H 4$ | CDRH3-52 | ATGACTACTCCTTACTGGTACTTCGGTCTC |
| 65C3<br>68D5<br>67F5 | 1203 | $V_H 5$<br>$V_H 5$<br>$V_H 5$ | CDRH3-53 | GAATATTACTATGGTTCGGGGAGTTATTA<br>TCCT |
| 63E6<br>66F7 | 1204 | $V_H 6$<br>$V_H 6$ | CDRH3-54 | GAACTCGGTGACTACCCCTTTTTTGACTAC |
| 64H5<br>65G4 | 1205 | $V_H 7$<br>$V_H 8$ | CDRH3-55 | GAATACGTAGCAGAAGCTGGTTTTGACT<br>AC |

TABLE 3C-continued

Coding Sequences for CDRHs

| Clone | SEQ ID NO: | Contained in Reference | Designation | Coding Sequences |
|---|---|---|---|---|
| 67G10v1 | 1206 | V$_H$9 | CDRH3-56 | GATAGTAGTGGGAGCTACTACGTGGAGG ACTACTTTGACTAC |
| 67G10v2 | | V$_H$9 | | |
| 63A10 | | V$_H$21 | | |
| 65H11 | | V$_H$22 | | |
| 64A7 | 1207 | V$_H$16 | CDRH3-57 | CTCCGAGGGGTCTACTGGTACTTCGATCTC |
| 65C1 | 1208 | V$_H$15 | CDRH3-58 | ATGACTTCCCCTTACTGGTACTTCGATCTC |
| 66B4 | 1209 | V$_H$10 | CDRH3-59 | GACGCAGCAACTGGTCGCTACTACTTTGA CAAC |
| 68G5 | 1210 | V$_H$12 | CDRH3-60 | GATCCTGGATACAGCTATGGTCACTTTGA CTAC |
| 66D4 | 1211 | V$_H$17 | CDRH3-61 | GAGACTGGAACTTGGAGCTTCTTTGACTAC |
| 65B1 | 1212 | V$_H$18 | CDRH3-62 | GAACTGGGGATCTTCAACTGGTTCGACCCC |
| 67A4 | 1213 | V$_H$19 | CDRH3-63 | GATCGGAGCAGTGGCCGGTTCGGGGACT ACTACGGTATGGACGTC |
| 65B4 | 1214 | V$_H$20 | CDRH3-64 | GATCGGAGCAGTGGCCGGTTCGGGGACT TCTACGGTATGGACGTC |
| 64C8 | 1215 | V$_H$23 | CDRH3-65 | GAATTACTATGGTTCGGGGAGTATGGGG TAGACCACGGTATGGACGTC |
| 65E3 | 1216 | V$_H$24 | CDRH3-66 | GATGTCTACGGTGACTATTTTGCGTAC |
| 65D4 | 1217 | V$_H$25 | CDRH3-67 | GCCCTCAACTGGAACTTTTTTGACTAC |
| 65D1 | 1218 | V$_H$26 | CDRH3-68 | GAAGGGACAACTCGACGGGGATTTGACT AC |
| 67G8 | 1219 | V$_H$27 | CDRH3-69 | TCAGCAGTGGCTTTGTACAACTGGTTCGA CCCC |
| 65B7 | 1220 | V$_H$28 | CDRH3-70 | GAGTCTAGGATATTGTACTTCAACGGGTA CTTCCAGCAC |
| 64A6 | 1221 | V$_H$29 | CDRH3-71 | GTCCTCCATTACTCTGATAGTCGTGGTTA CTCGTACTACTCTGACTTC |
| 65F9 | 1222 | V$_H$30 | CDRH3-72 | GTCCTCCATTACTATGATAGTAGTGGTTA CTCGTACTACTTTGACTAC |
| 64B10 | 1223 | V$_H$32 | CDRH3-73 | TATAGCAGCACCTGGGACTACTATTACG GTGTGGACGTC |
| 68C8 | 1224 | V$_H$33 | CDRH3-74 | TATAGGAGTGACTGGGACTACTACTACG GTATGGACGTC |
| 67A5 | 1225 | V$_H$34 | CDRH3-75 | CGGGCCTCACGTGGATACAGATTTGGTCT TGCTTTTGCGATC |
| 67C10 | 1226 | V$_H$35 | CDRH3-76 | CGGGCCTCACGTGGATACAGATATGGTC TTGCTTTTGCTATC |
| 64H6 | 1227 | V$_H$36 | CDRH3-77 | GTAGCAGTGTCTGCCTTCAACTGGTTCGA CCCC |
| 63F9 | 1228 | V$_H$37 | CDRH3-78 | GATGTTCTAATGGTGTATACTAAAGGGG GCTACTACTATTACGGTGTGGACGTC |
| 67F6 | 1229 | V$_H$38 | CDRH3-79 | CGGGCCTCACGTGGATACAGCTATGGTC ATGCTTTTGATTTC |
| 50D4 | 1230 | V$_H$87 | CDRH3-80 | GACCTTAGCAGTGGCTACTACTACTACGG TTTGGACGTG |
| 54H10.3 | 1231 | V$_H$91 | CDRH3-81 | GAGGAAGACTACAGTGACCACCACTACT TTGACTAC |

TABLE 3C-continued

Coding Sequences for CDRHs

| Clone | SEQ ID NO: | Contained in Reference | Designation | Coding Sequences |
|---|---|---|---|---|
| 66D4 | 1885 | $V_H17$ | CDRH3-82 | GAGACTGGAACTTGGAACTTCTTTGACTAC |
| 68D3v2 | 1886 | $V_H95$ | CDRH3-83 | ACGGTGACTGAGGAGGACTACTACTACT ACGGTATGGACGTC |

TABLE 3D

Coding Sequences for CDRLs

| Clone | SEQ ID NO: | Contained in Reference | Designation | Coding Sequence |
|---|---|---|---|---|
| 48C9 49A12 51E2 | 1232 | $V_L78$ | CDRL1-1 | CGGGCAAGTCAGAACATTAGGACCT ATTTAAAT |
| 48F3 | 1233 | $V_L77$ | CDRL1-2 | CGGGCAAGTCAGAGGATTAGCAGTT ATTTAAAT |
| 48F8 53B9 56B4 57E7 57F11 | 1234 | $V_L49$ | CDRL1-3 | CGGGCCAGTCAGGACATTGGTAATA GCTTACAC |
| 48H11 | 1235 | $V_L40$ | CDRL1-4 | CGGGCAAGTCAGAACATTAGGAGCT ATTTAAAT |
| 49A10 48D4 | 1236 | $V_L65$ | CDRL1-5 | AGGTCTAGTCAGAGCCTCTTGGATAG TGATGATGGAAACACCTATTTGGAC |
| 49C8 52H1 | 1237 | $V_L45$ | CDRL1-6 | CAGGCGAGTCAGGACATTAACATCTA TTTAAAT |
| 49G2 50C12 55G11 50G1 60D7 | 1238 | $V_L66$ $V_L66$ $V_L66$ $V_L90$ $V_L69$ | CDRL1-7 | AGGTCTAGTCAGAGCCTCTTGGATAG TGATGATGGAGACACCTATTTGGAC |
| 49G3 | 1239 | $V_L47$ | CDRL1-8 | CAGGCGAGTCAGGGCATTAGCAACT ATTTAAAT |
| 49H12 | 1240 | $V_L43$ | CDRL1-9 | CAGGCGAGTCAAGACATTACCAAAT ATTTAAAT |
| 51A8 | 1241 | $V_L61$ | CDRL1-10 | ACCCGCAGCAGTGGCAGCATTGCCA GCGACTATGTGCAG |
| 51C10.1 | 1242 | $V_L55$ | CDRL1-11 | TCTGGAGATGCATTGCCAAAAAAATA TGCTTAT |
| 51C10.2 | 1243 | $V_L70$ | CDRL1-12 | TCTGGAGATAAATTGGGGGATAAAT ACGTTTGC |
| 51E5 63G8v1 64A8 67B4 68D3 | 1244 | $V_L79$ $V_L1$ $V_L1$ $V_L1$ $V_L2$ | CDRL1-13 | CGGGCAAGTCAGGACATTAGAAATG ATTTAGGC |
| 51G2 | 1245 | $V_L51$ | CDRL1-14 | CGGGCGAGTCAGGGTATTAGCAGCT GGTTAGCC |
| 52A8 | 1246 | $V_L41$ | CDRL1-15 | CGGGCAAGTCAGACTATTAGCAGTTA TTTAAAT |
| 52B8 | 1247 | $V_L82$ | CDRL1-16 | AGGGCCAGTCAGAGTGTTAGCGACA TCTTAGCC |

TABLE 3D-continued

Coding Sequences for CDRLs

| Clone | SEQ ID NO: | Contained in Reference | Designation | Coding Sequence |
|---|---|---|---|---|
| 52C1 | 1248 | $V_L67$ | CDRL1-17 | TCTGGAAGCAGCTCCAACATTGGGAT TAATTATGTATCC |
| 52C5<br>55E4<br>49B11<br>50H10<br>53C1<br>56G1<br>51C1<br>60G5.1 | 1249 | $V_L73$<br>$V_L75$<br>$V_L75$<br>$V_L75$<br>$V_L75$<br>$V_L76$<br>$V_L95$<br>$V_L74$ | CDRL1-18 | CGGGCAAGTCAGAGCATTAGCAACT ATTTAAAT |
| 52F8 | 1250 | $V_L42$ | CDRL1-19 | AGGTCTAGTCAGAGCCTCCTGCATAG TAATGGATACAACTATTTGGAT |
| 52H2 | 1251 | $V_L84$ | CDRL1-20 | AGGGCCAGTCAGAGTGTTAGAAGCA GCTACTTAGCC |
| 53F6 | 1252 | $V_L63$ | CDRL1-21 | AGGTCTAGTCAGAGCCTCCAGCATAG TAATGGATACAACTATTTGGAT |
| 53H5.2<br>50G5 v1 | 1253 | $V_L62$<br>$V_L93$ | CDRL1-22 | CGGGCAAGTCAGGGCATTAGAAATG ATTTAGGC |
| 53H5.3 | 1254 | $V_L80$ | CDRL1-23 | AGGGCCAGTCAGAGTGTTAGCAGCA ACGTCGCC |
| 54A1<br>55G9 | 1255 | $V_L44$<br>$V_L44$ | CDRL1-24 | CAGGCGAGTCAGGACATTAGCATCTA TTTAAAT |
| 54H10.1<br>55D1<br>48H3<br>53C11 | 1256 | $V_L53$<br>$V_L53$<br>$V_L53$<br>$V_L53$ | CDRL1-25 | AGGGCCAGTCAGAGTTTTAGCAGCA GTTACTTAGCC |
| 55D3<br>50D4 | 1257 | $V_L71$<br>$V_L92$ | CDRL1-26 | CGGGCGAGTCAGGACATTAGCAATT ATTTAGCC |
| 55E9 | 1258 | $V_L68$ | CDRL1-27 | AGGTCTAGTCAGAGCCTCCTGCATAG TAACGGATTCAACTATTTGGAT |
| 55G5 | 1259 | $V_L83$ | CDRL1-28 | TCTGGAGACGAATTGGGGGATAAAT ATGCTTGC |
| 56A7<br>56E4 | 1260 | $V_L52$<br>$V_L52$ | CDRL1-29 | CGGGCGAGTCAGGATATTAGCAGTTG GTTAGCC |
| 56C11 | 1261 | $V_L64$ | CDRL1-30 | GGGGGAAACGACATTGGAAGTAAAA GTGTGCAC |
| 56E7 | 1262 | $V_L86$ | CDRL1-31 | CAGGCGAGTCAGGACATTAAAAAAT TTTTAAAT |
| 56G3.2 | 1263 | $V_L85$ | CDRL1-32 | e AGGGCCAGGCAGAGTGTTGGCAGT AACTTAATC |
| 56G3.3<br>55B10<br>61H5<br>52B9 | 1264 | $V_L81$<br>$V_L81$<br>$V_L88$ | CDRL1-33 | AGGGCCAGTCAGAGTGTTAGCAGAG ACTACTTAGCC |
| 57B12 | 1265 | $V_L72$ | CDRL1-34 | CGGGCGAGTCATGACATTAGCAATTA TTTAGCC |
| 57D9 | 1266 | $V_L87$ | CDRL1-35 | AGGGCCAGTCCGAGTGTTAGCAGCA GCTACTTAGCC |
| 53C3.2 | 1267 | $V_L96$ | CDRL1-36 | AGGGCCAGTCAGAGTATTAGCAGCA ATTTAGCC |
| 59C9<br>58A5<br>57A4<br>57F9 | 1268 | $V_L50$<br>$V_L50$<br>$V_L50$<br>$V_L50$ | CDRL1-37 | CGGGCGAGTCAGGATATTGACAGCT GGTTAGTC |

TABLE 3D-continued

Coding Sequences for CDRLs

| Clone | SEQ ID NO: | Contained in Reference | Designation | Coding Sequence |
|---|---|---|---|---|
| 59D10 v1 | 1269 | $V_L56$ | CDRL1-38 | TCTGGAGATGCAGTGCCAAAAAAT ATGCTAAT |
| 59D10 v2<br>65D1 | 1270 | $V_L57$<br>$V_L27$ | CDRL1-39 | TCTGGAGATAATTTGGGGGATAAATA TGCTTGC |
| 59G10.2 | 1271 | $V_L60$ | CDRL1-40 | TCTGGAGATAATTTGGGGGATAAATA TGCTTTC |
| 59G10.3 | 1272 | $V_L54$ | CDRL1-41 | TCTGGAAGCAGCTCCAACATTGGGGA TAATTATGTATCC |
| 54H10.3 | 1273 | $V_L97$ | CDRL1-42 | CGGGCAAGTCAGACCATTAGCATCTA TTTAAAT |
| 60F9<br>48B4<br>52D6 | 1274 | $V_L58$<br>$V_L58$<br>$V_L58$ | CDRL1-43 | AGGGCCAGTCAGAGGGTTCCCAGCA GCTACATAGTC |
| 60G5.2 | 1275 | $V_L46$ | CDRL1-44 | TCTGGAAATAAATTGGGGGATAAAT ATGTTTGC |
| 61G5 | 1276 | $V_L59$ | CDRL1-45 | AGGGCCAGTCAGAGAGTTCCCAGCA GCTACTTAGTC |
| 64E6<br>65E8<br>65F11<br>67G7<br>63H11<br>66F6 | 1277 | $V_L3$<br>$V_L3$<br>$V_L3$<br>$V_L3$<br>$V_L3$<br>$V_L15$ | CDRL1-46 | AGGGCCAGTCAGAGTGTTAGGAACA GCTACTTAGCC |
| 63B6<br>64D4 | 1278 | $V_L4$<br>$V_L4$ | CDRL1-47 | AGGGCCAGTCAGAGTGTTAGTAACA GCTACTTAGCC |
| 65C3<br>68D5 | 1279 | $V_L5$<br>$V_L5$ | CDRL1-48 | AGGGCCAGTCAGAGTGTTAGCAGCC AGTTAGCC |
| 63E6 | 1280 | $V_L6$ | CDRL1-49 | CGGACAAGTCAGAGTATTAGCAGCT ATTTAAAT |
| 66F7 | 1281 | $V_L7$ | CDRL1-50 | CGGACAAGTCAGAGCATTAGCAACT ATTTAAAT |
| 64H5<br>65G4<br>65E3<br>64H6 | 1282 | $V_L8$<br>$V_L8$<br>$V_L25$<br>$V_L37$ | CDRL1-51 | GGGGGAAACAACATTGGAAGTAAAA ATGTACAC |
| 67G10 v1<br>63A10<br>63A10v2 | 1283 | $V_L9$<br>$V_L22$<br>$V_L101$ | CDRL1-52 | GGGGGAAACAACATTGGAAGTAAAG CTGTGCAC |
| 67G10 v2 | 1284 | $V_L10$ | CDRL1-53 | TCTGGAGATAAATTGGGGGATAAAT ATGCTTGC |
| 63F5 | 1285 | $V_L14$ | CDRL1-54 | AGGGCCAGTCAGACTGTTAGGAACA ACTACTTAGCC |
| 64A7 | 1286 | $V_L17$ | CDRL1-55 | AGGGCCAGTCAGAGTGTTAGTCGCA ACTACTTAGCC |
| 65C1 | 1287 | $V_L16$ | CDRL1-56 | AGGGCCAGTCAGACTATTAGGAACA GCTACTTAGCC |
| 66B4 | 1288 | $V_L11$ | CDRL1-57 | CGGGCGAGTCAGGGTATTAGCAGGT GGTTAGCC |
| 55A7 | 1289 | $V_L98$ | CDRL1-58 | CGGGCAAGTCAGAGCATTAGCAGCT ATTTAAAT |

TABLE 3D-continued

Coding Sequences for CDRLs

| Clone | SEQ ID NO: | Contained in Reference | Designation | Coding Sequence |
|---|---|---|---|---|
| 68G5 | 1290 | V$_L$13 | CDRL1-59 | GGGGGTAACAACATTGGAAGTATAA ATGTGCAC |
| 66D4 | 1291 | V$_L$18 | CDRL1-60 | CGGGCAAGTCAGATCATTAGCAGGT ATTTAAAT |
| 65B1 | 1292 | V$_L$19 | CDRL1-61 | CGGGCAAGTCAGAACATTAACAACT ATTTAAAT |
| 67A4 | 1293 | V$_L$20 | CDRL1-62 | GGGGGAAACAACATTGGAAGTAAAA GTGTGCAC |
| 65B4 | 1294 | V$_L$21 | CDRL1-63 | GGGGGAAACAACATTGGAAGTAAAA GTGTGCAG |
| 55E6 | 1295 | V$_L$99 | CDRL1-64 | AGGGCCAGTCAGAGTGTTAGTCGCA GCCACTTAGCC |
| 65H11 | 1296 | V$_L$23 | CDRL1-65 | GGGGGAAACAACATTGGAAGTAAAA CTGTGCAC |
| 64C8 | 1297 | V$_L$24 | CDRL1-66 | AGGTCTAGTCCAAGCCTCGTATACAG TGATGGAAACACCTACTTGAAT |
| 65D4 | 1298 | V$_L$26 | CDRL1-67 | GGGGGAAATGACATTGGAAGTAAAA ATGTGCAC |
| 61E1 | 1299 | V$_L$100 | CDRL1-68 | CGGGCAAGTCAGAGCATTGGCACCTT TTTAAAT |
| 67G8 | 1300 | V$_L$28 | CDRL1-69 | GGGGGAAACAACATTGGAAGTTACA ATGTGTTC |
| 65B7 | 1301 | V$_L$29 | CDRL1-70 | AGGGCCAGTCAGAGTGTTAGCAGCA TGTACTTAGCC |
| 64A6 | 1302 | V$_L$30 | CDRL1-71 | AGGGCCAGTCAGAGTGTTAACAGCA ACTTAGCC |
| 65F9 67F5 | 1303 | V$_L$31 V$_L$32 | CDRL1-72 | AGGGCCAGTCAGAGTGTTAGCAGCA ACTTAGCC |
| 64B10 | 1304 | V$_L$33 | CDRL1-73 | TCTGGAAGCAGCTCCAATATTGGGAA TAATTATGTAGCC |
| 68C8 | 1305 | V$_L$34 | CDRL1-74 | TCTGGAAGCAGTTCCAACATTGGAAA TAATTATGTATCC |
| 67A5 67C10 | 1306 | V$_L$35 V$_L$36 | CDRL1-75 | AGGTCTAGTCAGAGCCTCTTAAATAG TGATGATGGAAATACCTATTTGGAC |
| 63F9 | 1307 | V$_L$38 | CDRL1-76 | CGGGCAAGTCAGGACATTAGAAATG ATTTAGCC |
| 67F6v1 67F6v2 | 1308 | V$_L$39 V$_L$39 | CDRL1-77 | AGGTCTAGTCAGAGCCTCTTAAATAG TGATGCTGGTACCACCTATTTGGAC |
| 50G5 v2 | 1309 | V$_L$94 | CDRL1-78 | AGGTCTAGTCAAAGACTCGTATACAG TGATGGAAACACCTACTTGAAT |
| 48G4 53C3.1 | 1310 | V$_L$89 V$_L$89 | CDRL1-79 | AGGGCCAGTCAGAGTGTTGCCAGCA GTTACTTAGTC |
| 58C2 | 1311 | V$_L$91 | CDRL1-81 | AGGTCTAGTCAGAGCCTCTTCGATAA TGATGATGGAGACACCTATTTGGAC |
| 65B7v1 | 1887 | V$_L$29 | CDRL1-82 | AGGGCCAGTCAGAGTGTTAGCAGCA TCTACTTAGCC |
| 65B7v2 | 1888 | V$_L$107 | CDRL1-83 | AGGTCTAGTCAAAGCCTCGTATACAG TGATGGAGACACCTACTTGAAT |
| 63G8v3 63G8v2 | 1889 | V$_L$106 V$_L$105 | CDRL1-84 | CGGGCAAGTCAGGGCATTAGAAGTG GTTTAGGC |

TABLE 3D-continued

Coding Sequences for CDRLs

| Clone | SEQ ID NO: | Contained in Reference | Designation | Coding Sequence |
|---|---|---|---|---|
| 63A10v3 | 1890 | $V_L$102 | CDRL1-85 | TCTGGAGATAAATTGGGGAATAGAT ATACTTGC |
| 65H11v2 | 1891 | $V_L$23 | CDRL1-86 | TCTGGAGATAAATTGGGGGATAGAT ATGTTTGT |
| 48C9 | 1312 | $V_L$78 | CDRL2-1 | GTTGCATCCAGTTTGGAAAGT |
| 49A12 | | $V_L$78 | | |
| 51E2 | | $V_L$78 | | |
| 48F3 | 1313 | $V_L$77 | CDRL2-2 | GCTGTATCCAGTTTGCAAAGT |
| 48F8 | 1314 | $V_L$49 | CDRL2-3 | TTTGCTTCCCAGTCCTTCTCA |
| 53B9 | | $V_L$49 | | |
| 56B4 | | $V_L$49 | | |
| 57E7 | | $V_L$49 | | |
| 57F11 | | $V_L$49 | | |
| 48H11 | 1315 | $V_L$40 | CDRL2-4 | GGTGCATCTAATTTACAGAGT |
| 49A10 | 1316 | $V_L$65 | CDRL2-5 | ACGCTTTCCTATCGGGCCTCT |
| 48D4 | | $V_L$65 | | |
| 49G2 | | $V_L$66 | | |
| 50C12 | | $V_L$66 | | |
| 55G11 | | $V_L$66 | | |
| 60D7 | | $V_L$69 | | |
| 67A5 | | $V_L$35 | | |
| 67C10 | | $V_L$36 | | |
| 50G1 | | $V_L$90 | | |
| 60D7 | | $V_L$36 | | |
| 58C2 | | $V_L$91 | | |
| 49C8 | 1317 | $V_L$45 | CDRL2-6 | GATGTATCCAATTTGGAAACA |
| 52H1 | | $V_L$45 | | |
| 54A1 | | $V_L$44 | | |
| 55G9 | | $V_L$44 | | |
| 49G3 | 1318 | $V_L$47 | CDRL2-7 | GATGCATCCAATTTGGAAACA |
| 56E7 | | $V_L$86 | | |
| 49H12 | 1319 | $V_L$43 | CDRL2-8 | GATACATTCATTTTGGAAACA |
| 51A8 | 1320 | $V_L$61 | CDRL2-9 | GAGGATAAAGAAAGATCCTCT |
| 51C10.1 | 1321 | $V_L$55 | CDRL2-10 | GAGGACAGCAAACGACCCTCC |
| 59D10 v1 | | $V_L$56 | | |
| 51C10.2 | 1322 | $V_L$70 | CDRL2-11 | CAAAATAACAAGCGGCCCTCA |
| 59G10.2 | | $V_L$60 | | |
| 51E5 | 1323 | $V_L$79 | CDRL2-12 | GCTGCATCCAGTTTGCAATTT |
| 51G2 | 1324 | $V_L$51 | CDRL2-13 | GATGCATCCAGTTTGCAAAGT |
| 52A8 | 1325 | $V_L$41 | CDRL2-14 | GCTGCATCCAGTTTGCAAAGT |
| 52C5 | | $V_L$73 | | |
| 53H5.2 | | $V_L$62 | | |
| 55D3 | | $V_L$71 | | |
| 56G1 | | $V_L$76 | | |
| 57B12 | | $V_L$72 | | |
| 63E6 | | $V_L$6 | | |
| 66F7 | | $V_L$7 | | |
| 66D4 | | $V_L$18 | | |
| 50G5 v1 | | $V_L$93 | | |
| 51C1 | | $V_L$95 | | |
| 55A7 | | $V_L$98 | | |
| 61E1 | | $V_L$100 | | |
| 60G5.1 | | $V_L$74 | | |
| 52B8 | 1326 | $V_L$82 | CDRL2-15 | GGTGCATCCACCAGGGCCACT |
| 53H5.3 | | $V_L$80 | | |
| 65F9 | | $V_L$31 | | |

TABLE 3D-continued

Coding Sequences for CDRLs

| Clone | SEQ ID NO: | Contained in Reference | Designation | Coding Sequence |
|---|---|---|---|---|
| 52C1 | 1327 | $V_L$67 | CDRL2-16 | GACAATAATAAGCGACCCTCA |
| 59G10.3 | | $V_L$54 | | |
| 68C8 | | $V_L$34 | | |
| 52F8 | 1328 | $V_L$42 | CDRL2-17 | TTGGGTTCTAATCGGGCCTCC |
| 55E9 | | $V_L$68 | | |
| 52H2 | 1329 | $V_L$84 | CDRL2-18 | GGTGCATCCAGGAGGGCCACT |
| 53F6 | 1330 | $V_L$63 | CDRL2-19 | TTGGATTCTAATCGGGCCTCC |
| 54H10.1 | 1331 | $V_L$53 | CDRL2-20 | GGTGCATCCAGCAGGGCCACT |
| 55D1 | | $V_L$53 | | |
| 48H3 | | $V_L$53 | | |
| 53C11 | | $V_L$53 | | |
| 57D9 | | $V_L$87 | | |
| 61H5 | | $V_L$88 | | |
| 52B9 | | $V_L$88 | | |
| 63F5 | | $V_L$14 | | |
| 64A7 | | $V_L$17 | | |
| 65B7v1 | | $V_L$29 | | |
| 55E6 | | $V_L$99 | | |
| 55E4 | 1332 | $V_L$75 | CDRL2-21 | ACAGCTTCCAGTTTGCAAAGT |
| 49BG11 | | $V_L$75 | | |
| 50H10 | | $V_L$75 | | |
| 53C1 | | $V_L$75 | | |
| 50G5v2 | 1333 | $V_L$94 | CDRL2-22 | AAGGTTTCTAACTGGGACTCT |
| 65B7v2 | | $V_L$107 | | |
| 55G5 | 1334 | $V_L$83 | CDRL2-23 | CAAGATACCAAGCGGCCCTCA |
| 56A7 | 1335 | $V_L$52 | CDRL2-24 | GATGCATCCACTTTGCAAAGT |
| 56E4 | | $V_L$52 | | |
| 56C11 | 1336 | $V_L$64 | CDRL2-25 | GATGATAGCGACCGGCCCTCA |
| 67A4 | | $V_L$20 | | |
| 65B4 | | $V_L$21 | | |
| 56G3.2 | 1337 | $V_L$85 | CDRL2-26 | GGTGCATCCAGCAGGGACACT |
| 56G3.3 | 1338 | $V_L$81 | CDRL2-27 | GGTGCATCCGCCAGGGCCACT |
| 55B10 | | $V_L$81 | | |
| 59A10 | 1339 | $V_L$48 | CDRL2-28 | GGTGCATCCAGTTTGCAAAGT |
| 49H4 | | $V_L$48 | | |
| 59C9 | 1340 | $V_L$50 | CDRL2-29 | GCTGCATCCAATTTGCAAAGA |
| 58A5 | | $V_L$50 | | |
| 57A4 | | $V_L$50 | | |
| 57F9 | | $V_L$50 | | |
| 63G8v1 | | $V_L$104 | | |
| 63GBv2 | | $V_L$105 | | |
| 63G8v3 | | $V_L$106 | | |
| 64A8 | | $V_L$1 | | |
| 67B4 | | $V_L$1 | | |
| 68D3 | | $V_L$1 | | |
| 59D10 v2 | 1341 | $V_L$57 | CDRL2-30 | CAAGATACCAAGCGGCCCTCA |
| 60F9 | 1342 | $V_L$58 | CDRL2-31 | GGTTCATCCAACAGGGCCACT |
| 48B4 | | $V_L$58 | | |
| 52D6 | | $V_L$58 | | |
| 60G5.2 | 1343 | $V_L$46 | CDRL2-32 | CAAGATAGCAAGCGGCCCTCA |
| 65D1 | | $V_L$27 | | |
| 65H11v2 | | $V_L$103 | | |
| 61G5 | 1344 | $V_L$59 | CDRL2-33 | GGTGCATCCAACAGGGCCACA |

TABLE 3D-continued

Coding Sequences for CDRLs

| Clone | SEQ ID NO: | Contained in Reference | Designation | Coding Sequence |
|---|---|---|---|---|
| 64E6 | 1345 | $V_L3$ | CDRL2-34 | GGTGCATTTAGCAGGGCCTCT |
| 65E8 | | $V_L3$ | | |
| 65F11 | | $V_L3$ | | |
| 67G7 | | $V_L3$ | | |
| 63H11 | | $V_L3$ | | |
| 63B6 | 1346 | $V_L4$ | CDRL2-35 | GGTGCATTCAGTAGGGCCACT |
| 64D4 | | $V_L4$ | | |
| 65C1 | | $V_L16$ | | |
| 66F6 | | $V_L15$ | | |
| 48G4 | | $V_L83$ | | |
| 53C3.1 | | $V_L83$ | | |
| 65C3 | 1347 | $V_L5$ | CDRL2-36 | GGTGCCTCCAACAGGGCCATT |
| 68D5 | | $V_L5$ | | |
| 64H5 | 1348 | $V_L8$ | CDRL2-37 | AGGGATAGCAAGCGGCCCTCT |
| 65G4 | | $V_L8$ | | |
| 67G8 | | $V_L28$ | | |
| 64H6 | | $V_L37$ | | |
| 67G10 v1 | 1349 | $V_L9$ | CDRL2-38 | AGCGATAGCAACCGGCCCTCA |
| 65H11 | | $V_L23$ | | |
| 67G10 v2 | 1350 | $V_L10$ | CDRL2-39 | CAAGATAACGAGCGGCCCTCA |
| 66B4 | 1351 | $V_L11$ | CDRL2-40 | GCTGCATCCAGTTTGAAAAGT |
| 66G2 | 1352 | $V_L12$ | CDRL2-41 | GCTGCATCCAATTTGCAAAGT |
| 68G5 | 1353 | $V_L13$ | CDRL2-42 | AGGGATAGGAACCGGCCCTCT |
| 65E3 | | $V_L25$ | | |
| 65D4 | | $V_L26$ | | |
| 65B1 | 1354 | $V_L19$ | CDRL2-43 | ACTACATCCAGTTTGCAAAGT |
| 53C3.2 | 1355 | $V_L96$ | CDRL2-44 | GGTACATCCATCAGGGCCAGT |
| 63A10v1 | 1356 | $V_L22$ | CDRL2-45 | TGTGATAGCAACCGGCCCTCA |
| 63A10v2 | | $V_L101$ | | |
| 54H10.3 | 1357 | $V_L97$ | CDRL2-46 | TCTGCATCCAGTTTGCAAAGT |
| 64C8 | 1358 | $V_L24$ | CDRL2-47 | AAGGGTTCTAACTGGGACTCA |
| 64A6 | 1359 | $V_L30$ | CDRL2-48 | GGTACATCCACCAGGGCCACT |
| 67F5 | 1360 | $V_L32$ | CDRL2-49 | GGTTCATCCAACAGGGCCATT |
| 64B10 | 1361 | $V_L33$ | CDRL2-50 | GACAATGATAAGCGACCCTCA |
| 63F9 | 1362 | $V_L38$ | CDRL2-51 | GCTTCATCCAGTTTGCAAAGT |
| 67F6v2 | 1363 | $V_L39$ | CDRL2-52 | ACGCTTTCCTTTCGGGCCTCT |
| 50D4 | 1364 | $V_L92$ | CDRL2-53 | GCTGCATCCACTTTGCTATCA |
| 68A10v3 | 1892 | $V_L102$ | CDRL2-54 | CAAGATAGCGAGCGGCCCTCA |
| 48C9 | 1365 | $V_L78$ | CDRL3-1 | CAACAGAGTGACAGTATCCCTCGGACG |
| 49A12 | | | | |
| 51E2 | | | | |
| 48F3 | 1366 | $V_L77$ | CDRL3-2 | CAACAGAGTTACAGTGCTACATTCACT |
| 48F8 | 1367 | $V_L49$ | CDRL3-3 | CATCAGAGTAGTGATTTACCGCTCACT |
| 53B9 | | $V_L49$ | | |
| 56B4 | | $V_L49$ | | |
| 57E7 | | $V_L49$ | | |
| 57F11 | | $V_L49$ | | |

TABLE 3D-continued

Coding Sequences for CDRLs

| Clone | SEQ ID NO: | Contained in Reference | Designation | Coding Sequence |
|---|---|---|---|---|
| 48H11 | 1368 | $V_L40$ | CDRL3-4 | CAACAGAGTTACAATACCCCGTGCAGT |
| 49A10 | 1369 | $V_L65$ | CDRL3-5 | ATGCAACGTATAGAGTTTCCGATCACC |
| 48D4 | | $V_L65$ | | |
| 67F6v2 | | $V_L108$ | | |
| 49C8 | 1370 | $V_L45$ | CDRL3-6 | CAACAATATGATAATCTCCCATTCACT |
| 52H1 | | $V_L45$ | | |
| 67C10 | | $V_L36$ | | |
| 67F6v1 | | $V_L39$ | | |
| 49G2 | 1371 | $V_L66$ | CDRL3-7 | ATGCAACATATAGAATTTCCTTCGACC |
| 50C12 | | $V_L66$ | | |
| 55G11 | | $V_L66$ | | |
| 49G3 | 1372 | $V_L47$ | CDRL3-8 | CACCAGTATGATGATCTCCCGCTCACT |
| 49H12 | 1373 | $V_L43$ | CDRL3-9 | CAACAGTATGACAATTTACCGCTCACC |
| 54A1 | | $V_L44$ | | |
| 55G9 | | $V_L44$ | | |
| 51A8 | 1374 | $V_L61$ | CDRL3-10 | CAGTCTTATGATCGCAACAATCATGTGGTT |
| 51C10.1 | 1375 | $V_L55$ | CDRL3-11 | TACTCAACAGACAGCAGTGTTAATCATGTGGTA |
| 51C10.2 | 1376 | $V_L70$ | CDRL3-12 | CAGGCGTGGGATAGTAGTACTGCGGTA |
| 51E5 | 1377 | $V_L79$ | CDRL3-13 | CTACAACATAGTAGTTACCCGCTCACT |
| 51G2 | 1378 | $V_L51$ | CDRL3-14 | CAACAGACTAACAGTTTCCCTCCGTGGACG |
| 56A7 | | $V_L52$ | | |
| 56E4 | | $V_L52$ | | |
| 59A10 | | $V_L48$ | | |
| 49H4 | | $V_L48$ | | |
| 59C9 | | $V_L50$ | | |
| 58A5 | | $V_L50$ | | |
| 57A4 | | $V_L50$ | | |
| 57F9 | | $V_L50$ | | |
| 52A8 | 1379 | $V_L41$ | CDRL3-15 | CAGCAGAGTTACAGTACCCCGCTCACT |
| 65B1 | | $V_L19$ | | |
| 52B8 | 1380 | $V_L82$ | CDRL3-16 | CAGCAGTATAATAACTGGCCGCTCACT |
| 56G3.2 | | $V_L85$ | | |
| 52C1 | 1381 | $V_L67$ | CDRL3-17 | GGAACATGGGATAGCAGCCTGAGTGCTGTGGTA |
| 64B10 | | $V_L33$ | | |
| 68C8 | | $V_L34$ | | |
| 52C5 | 1382 | $V_L73$ | CDRL3-18 | CAACAGAGTTCCAGTATCCCTTGGACG |
| 55E4 | | $V_L75$ | | |
| 49B11 | | $V_L75$ | | |
| 50H10 | | $V_L75$ | | |
| 53C1 | | $V_L75$ | | |
| 51C1 | | $V_L95$ | | |
| 60G5.1 | | $V_L74$ | | |
| 52F8 | 1383 | $V_L42$ | CDRL3-19 | ATGCAAGCTCTACAAACTCCATTCACT |
| 52H2 | 1384 | $V_L84$ | CDRL3-20 | CAGCAGTATGGTAGTTCACCTCGCAGT |
| 53F6 | 1385 | $V_L63$ | CDRL3-21 | ATGCAAGGTCTACAAACTCCTCCCACT |
| 53H5.2 | 1386 | $V_L62$ | CDRL3-22 | CTACAGCATAAGAGTTACCCATTCACT |
| 53H5.3 | 1387 | $V_L80$ | CDRL3-23 | CAGCAGTTTAGTAACTCAATCACC |
| 54H10.1 | 1388 | $V_L53$ | CDRL3-24 | CAGCAGTATGGTAGCTCACGGACG |
| 55D1 | | $V_L53$ | | |
| 48H3 | | $V_L53$ | | |
| 53C11 | | $V_L53$ | | |

TABLE 3D-continued

Coding Sequences for CDRLs

| Clone | SEQ ID NO: | Contained in Reference | Designation | Coding Sequence |
|---|---|---|---|---|
| 55D3 | 1389 | $V_L$71 | CDRL3-25 | CAACAGTATAATATTTACCCTCGGACG |
| 55E9 | 1390 | $V_L$68 | CDRL3-26 | ATGCAAGCTCTACAAACTCTCATCACC |
| 55G5 | 1391 | $V_L$83 | CDRL3-27 | CAGGCGTGGGACAGCGGCACTGTGGTA |
| 56C11 | 1392 | $V_L$64 | CDRL3-28 | CAGGTGTGGGATAGTAGTAGTGATGTGGTA |
| 56E7 | 1393 | $V_L$86 | CDRL3-29 | CAACAATATGCTATTCTCCCATTCACT |
| 56G1 | 1394 | $V_L$76 | CDRL3-30 | CAACAGAGTTCCACTATCCCTTGGACG |
| 56G3.3 55B10 61H5 52B9 | 1395 | $V_L$81 $V_L$81 $V_L$88 $V_L$88 | CDRL3-31 | CAGCAATATGGTAGATCACTATTCACT |
| 57B12 | 1396 | $V_L$72 | CDRL3-32 | CAACAATATAATACTTACCCTCGGACG |
| 57D9 | 1397 | $V_L$87 | CDRL3-33 | CATCAGTATGGTACCTCACCGTGCAGT |
| 59D10 v1 | 1398 | $V_L$56 | CDRL3-34 | TACTCAACAGACAGCAGTGGTAATCATGTGGTA |
| 59D10 v2 | 1399 | $V_L$57 | CDRL3-35 | CAGGCGTGGGACAGCAGCACTACATGGGTG |
| 59G10.2 | 1400 | $V_L$60 | CDRL3-36 | CAGGCGTGGGACAGCGCCACTGTGATT |
| 59G10.3 | 1401 | $V_L$54 | CDRL3-37 | GGAACATGGGACAGCAGCCTGAGTGTTATGGTT |
| 60D7 50G1 | 1402 | $V_L$69 $V_L$90 | CDRL3-38 | ATGCAACGTATAGAGTTTCCGCTCACT |
| 60F9 48B4 52D6 61G5 | 1403 | $V_L$58 $V_L$58 $V_L$58 $V_L$59 | CDRL3-39 | CAGCAGTATGGTAGCTCACCTCCGTGGACG |
| 60G5.2 | 1404 | $V_L$46 | CDRL3-40 | CAGGCGTGGGACAGCAGCACTTGGGTG |
| 63G8v1 63G8v2 64A8 67B4 68D3 | 1405 | $V_L$104 $V_L$105 $V_L$1 $V_L$1 $V_L$2 | CDRL3-41 | CTCCAGCATAATAGTTACCCTCTCACT |
| 64E6 65E8 65F11 67G7 63H11 63F5 65C1 66F6 | 1406 | $V_L$3 $V_L$3 $V_L$3 $V_L$3 $V_L$ $V_L$14 $V_L$16 $V_L$15 | CDRL3-42 | CAGCAGTTTGGAAGCTCACTCACT |
| 63B6 64D4 | 1407 | $V_L$4 $V_L$4 | CDRL3-43 | CAGCAGTTTGGTAGGTCATTCACT |
| 65C3 68D5 | 1408 | $V_L$5 $V_L$5 | CDRL3-44 | CAGCAGTATAATAACTGGCCGTGGACG |
| 63E6 66F7 | 1409 | $V_L$6 $V_L$7 | CDRL3-45 | CAACAGAGTTACAGTACCTCGCTCACT |
| 64H5 65G4 | 1410 | $V_L$8 $V_L$8 | CDRL3-46 | CAGGTGTGGGACAGCAGTAGTGTGGTA |

TABLE 3D-continued

Coding Sequences for CDRLs

| Clone | SEQ ID NO: | Contained in Reference | Designation | Coding Sequence |
|---|---|---|---|---|
| 67G10 v1 | 1411 | $V_L9$ | CDRL3-47 | CAGGTGTGGGACAGTAGTAGTGATGGGGTA |
| 67G10 v2 63A10v2 63A10v3 | 1412 | $V_L10$ $V_L101$ $V_L102$ | CDRL3-48 | CAGGCGTGGGACAGCACCACTGTGGTA |
| 64A7 | 1413 | $V_L17$ | CDRL3-49 | CAGCAGTATGGTAGTTCATCTCTGTGCAGT |
| 66B4 | 1414 | $V_L11$ | CDRL3-50 | CAACAGGCTAACAGTTTCCCTCCGACG |
| 66G2 | 1415 | $V_L12$ | CDRL3-51 | CTACAACTTAATGGTTACCCTCTCACT |
| 68G5 | 1416 | $V_L13$ | CDRL3-52 | CAGTTGTGGGACAGCAGCACTGTGGTT |
| 66D4 54H10.3 | 1417 | $V_L18$ $V_L97$ | CDRL3-53 | CAACAGAGTTACAGTTCCCCGCTCACT |
| 55A7 | 1418 | $V_L98$ | CDRL3-54 | CAACAGACTTACAGTGCCCCATTCACT |
| 67A4 65B4 | 1419 | $V_L20$ $V_L21$ | CDRL3-55 | CAGGTGTGGGATAGTAGTAGTGATCATGTGGTA |
| 63A10 | 1420 | $V_L22$ | CDRL3-56 | CATGCGTGTGGGAGCAGTAGTAGCGATGGGGTA |
| 65H11 | 1421 | $V_L23$ | CDRL3-57 | CAGGTGTGGGACAGTAGTTGTGATGGGGTA |
| 64C8 | 1422 | $V_L24$ | CDRL3-58 | ATACAAGATACACACTGGCCCACGTGCAGT |
| 65E3 67G8 | 1423 | $V_L25$ $V_L28$ | CDRL3-59 | CAGGTGTGGGACAGCAGCACTGTGGTC |
| 65D4 | 1424 | $V_L26$ | CDRL3-60 | CAGGTGTGGGACAGCAACCCTGTGGTA |
| 65D1 | 1425 | $V_L27$ | CDRL3-61 | CAGGCGTGGGACAGCAGGGTA |
| 65B7v1 | 1426 | $V_L29$ | CDRL3-62 | CAGCAGTATGGTAGCTCGTGCAGT |
| 64A6 65F9 | 1427 | $V_L30$ $V_L31$ | CDRL3-63 | CAGCAATATAATACCTGGCCGTGGACG |
| 67F5 | 1428 | $V_L32$ | CDRL3-64 | CAGCAGTATGAAATTTGGCCGTGGACG |
| 55E6 | 1429 | $V_L99$ | CDRL3-65 | CAGCAGTATGGTAGTTCACCGTGGACG |
| 67A5 58C2 | 1430 | $V_L35$ $V_L91$ | CDRL3-66 | ATGCAACGTCTAGAGTTTCCTATTACC |
| 61E1 | 1431 | $V_L100$ | CDRL3-67 | CAACAGAGTTTCAGTACCCCGCTCACT |
| 64H6 | 1432 | $V_L37$ | CDRL3-68 | CAGGTGTGGGACAGCAGTCCTGTGGTA |
| 63F9 | 1433 | $V_L38$ | CDRL3-69 | CTACAGCGTAATAGTTACCCGCTCACT |
| 53C3.2 | 1434 | $V_L96$ | CDRL3-70 | CACCAGTATACTAACTGGCCTCGGACG |
| 48G4 53C3.1 | 1435 | $V_L89$ $V_L89$ | CDRL3-71 | CAGCAGTATGGTACCTCACCATTTACT |
| 50G5 v1 | 1436 | $V_L93$ | CDRL3-72 | CTACAGCATAATAGTTACCCTCGGACG |
| 64B10v2 | 1893 | $V_L33$ | CDRL3-73 | TATAGCAGCACCTGGGACTACTATTACGGTGTGGACGTC |
| 50D4 | 1437 | $V_L92$ | CDRL3-74 | CAAAAGTATTACAGTGCCCCTTTCACT |
| 50G5 v2 | 1438 | $V_L94$ | CDRL3-75 | ATGGAAGGTACACACTGGCCTCGGGAC |

TABLE 3D-continued

Coding Sequences for CDRLs

| Clone | SEQ ID NO: | Contained in Reference | Designation | Coding Sequence |
|---|---|---|---|---|
| 63G8v3 | 1894 | $V_L$106 | CDRL3-76 | CTCCAACATAATACTTACCCTCTCACT |
| 65B7v2 | 1895 | $V_L$107 | CDRL3-77 | ATGCAAGGTACACACTGGCGGGGTTGGACG |
| 65H11v2 | 1896 | $V_L$103 | CDRL3-78 | CAGGCGTGGGACAGCATCACTGTGGTA |
| 63A10v1 | 1897 | $V_H$21 | CDRL3-79 | CAGGTGTGGGACAGTAGTAGTGATGGGGTA |

The structure and properties of CDRs within a naturally occurring antibody has been described, supra. Briefly, in a traditional antibody, the CDRs are embedded within a framework in the heavy and light chain variable region where they constitute the regions responsible for antigen binding and recognition. A variable region comprises at least three heavy or light chain CDRs, see, e.g., Kabat et al., (1991) "Sequences of Proteins of Immunological Interest", 5$^{th}$ Ed., US Dept. of Health and Human Services, PHS, NIH, NIH Publication no. 91-3242; see also Chothia and Lesk, (1987) *J. Mol. Biol.* 196:901-917; Chothia et al., (1989) *Nature* 342: 877-883), within a framework region (designated framework regions 1-4, FR1, FR2, FR3, and FR4, by Kabat et al., (1991); see also Chothia and Lesk, (1987) supra). The CDRs provided herein, however, can not only be used to define the antigen binding domain of a traditional antibody structure, but can be embedded in a variety of other polypeptide structures, as described herein.

In one aspect, the CDRs provided are (a) a CDRH selected from the group consisting of (i) a CDRH1 selected from the group consisting of SEQ ID NOS 603-655; (ii) a CDRH2 selected from the group consisting of SEQ ID NOS 656-732; (iii) a CDRH3 selected from the group consisting of SEQ ID NOS 733-813; and (iv) a CDRH of (i), (ii) and (iii) that contains one or more amino acid substitutions, deletions or insertions of no more than five, four, three, two, or one amino acids; (B) a CDRL selected from the group consisting of (i) a CDRL1 selected from the group consisting of SEQ ID NOS 814-893; (ii) a CDRL2 selected from the group consisting of SEQ ID NOS 894-946; (iii) a CDRL3 selected from the group consisting of SEQ ID NOS 947-1020; and (iv) a CDRL of (i), (ii) and (iii) that contains one or more amino acid substitutions, deletions or insertions of no more than 1, 2, 3, 4, or 5 amino acids amino acids.

In another aspect, an antigen binding protein comprises 1, 2, 3, 4, 5, or 6 variant forms of the CDRs listed in Tables 3A and 3B, infra, each having at least 80%, 85%, 90%, 95%, 96%, 97%, 98%, or 99% sequence identity to a CDR sequence listed in Tables 3A and 3B, infra. Some antigen binding proteins comprise 1, 2, 3, 4, 5, or 6 of the CDRs listed in Tables 3A and 3B, infra, each differing by no more than 1, 2, 3, 4 or 5 amino acids from the CDRs listed in these tables.

In still another aspect, an antigen binding protein includes the following associations of CDRL1, CDRL2 and CDRL3, presented for convenience in tabular form and in reference to the clone source of the association:

TABLE 4

CDRL Associations

| Clone ID | CDRL1 | CDRL2 | CDRL3 |
|---|---|---|---|
| 63G8 | CDRL1-13 | CDRL2-29 | CDRL3-41 |
| 64A8 | CDRL1-13 | CDRL2-29 | CDRL3-41 |
| 67B4 | CDRL1-13 | CDRL2-29 | CDRL3-41 |
| 68D3 | CDRL1-13 | CDRL2-29 | CDRL3-41 |
| 64E6 | CDRL1-46 | CDRL2-34 | CDRL3-42 |
| 65E8 | CDRL1-46 | CDRL2-34 | CDRL3-42 |
| 65F11 | CDRL1-46 | CDRL2-34 | CDRL3-42 |
| 67G7 | CDRL1-46 | CDRL2-34 | CDRL3-42 |
| 63B6 | CDRL1-47 | CDRL2-3 | CDRL3-43 |
| 64D4 | CDRL1-47 | CDRL2-3 | CDRL3-43 |
| 65C3 | CDRL1-48 | CDRL2-36 | CDRL3-44 |
| 68D5 | CDRL1-48 | CDRL2-36 | CDRL3-44 |
| 63E6 | CDRL1-49 | CDRL2-14 | CDRL3-45 |
| 66F7 | CDRL1-50 | CDRL2-14 | CDRL3-45 |
| 64H5 | CDRL1-51 | CDRL2-37 | CDRL3-46 |
| 65G4 | CDRL1-51 | CDRL2-37 | CDRL3-46 |
| 67G10v1 | CDRL1-52 | CDRL2-38 | CDRL3-47 |
| 67G10v2 | CDRL1-53 | CDRL2-39 | CDRL3-48 |
| 66B4 | CDRL1-57 | CDRL2-40 | CDRL3-50 |
| 66G2 | CDRL1-22 | CDRL2-41 | CDRL3-51 |
| 68G5 | CDRL1-59 | CDRL2-42 | CDRL3-52 |
| 63F5 | CDRL1-54 | CDRL2-20 | CDRL3-42 |
| 66F6 | CDRL1-46 | CDRL2-35 | CDRL3-42 |
| 65C1 | CDRL1-56 | CDRL2-35 | CDRL3-42 |
| 64A7 | CDRL1-55 | CDRL2-20 | CDRL3-49 |
| 66D4 | CDRL1-60 | CDRL2-14 | CDRL3-53 |
| 65B1 | CDRL1-61 | CDRL2-43 | CDRL3-15 |
| 67A4 | CDRL1-62 | CDRL2-25 | CDRL3-55 |
| 65B4 | CDRL1-63 | CDRL2-25 | CDRL3-55 |
| 63A10 | CDRL1-52 | CDRL2-45 | CDRL3-56 |
| 65H11 | CDRL1-65 | CDRL2-38 | CDRL3-57 |
| 64C8 | CDRL1-66 | CDRL2-47 | CDRL3-58 |
| 65E3 | CDRL1-51 | CDRL2-42 | CDRL3-59 |
| 65D4 | CDRL1-67 | CDRL2-42 | CDRL3-60 |
| 65D1 | CDRL1-39 | CDRL2-32 | CDRL3-61 |
| 67G8 | CDRL1-69 | CDRL2-37 | CDRL3-59 |
| 65B7 | CDRL1-70 | CDRL2-20 | CDRL3-62 |
| 64A6 | CDRL1-71 | CDRL2-48 | CDRL3-63 |
| 65F9 | CDRL1-72 | CDRL2-15 | CDRL3-63 |
| 67F5 | CDRL1-72 | CDRL2-49 | CDRL3-64 |
| 64B10 | CDRL1-73 | CDRL2-50 | CDRL3-17 |
| 68C8 | CDRL1-74 | CDRL2-16 | CDRL3-17 |
| 67A5 | CDRL1-75 | CDRL2-5 | CDRL3-66 |
| 67C10 | CDRL1-75 | CDRL2-5 | CDRL3-5 |
| 64H6 | CDRL1-51 | CDRL2-37 | CDRL3-68 |
| 63F9 | CDRL1-76 | CDRL2-51 | CDRL3-69 |
| 67F6 | CDRL1-77 | CDRL2-52 | CDRL3-5 |
| 48H11 | CDRL1-4 | CDRL2-4 | CDRL3-4 |
| 52A8 | CDRL1-15 | CDRL2-14 | CDRL3-15 |
| 52F8 | CDRL1-19 | CDRL2-17 | CDRL3-19 |
| 49H12 | CDRL1-9 | CDRL2-8 | CDRL3-9 |
| 54A1 | CDRL1-24 | CDRL2-6 | CDRL3-9 |

TABLE 4-continued

CDRL Associations

| Clone ID | CDRL1 | CDRL2 | CDRL3 |
| --- | --- | --- | --- |
| 55G9 | CDRL1-24 | CDRL2-6 | CDRL3-9 |
| 49C8 | CDRL1-6 | CDRL2-6 | CDRL3-6 |
| 52H1 | CDRL1-6 | CDRL2-6 | CDRL3-6 |
| 60G5.2 | CDRL1-44 | CDRL2-32 | CDRL3-40 |
| 49G3 | CDRL1-8 | CDRL2-7 | CDRL3-8 |
| 59A10 | CDRL1-14 | CDRL2-28 | CDRL3-14 |
| 49H4 | CDRL1-14 | CDRL2-28 | CDRL3-14 |
| 48F8 | CDRL1-3 | CDRL2-3 | CDRL3-3 |
| 53B9 | CDRL1-3 | CDRL2-3 | CDRL3-3 |
| 56B4 | CDRL1-3 | CDRL2-3 | CDRL3-3 |
| 57E7 | CDRL1-3 | CDRL2-3 | CDRL3-3 |
| 57F11 | CDRL1-3 | CDRL2-3 | CDRL3-3 |
| 59C9 | CDRL1-37 | CDRL2-29 | CDRL3-14 |
| 58A5 | CDRL1-37 | CDRL2-29 | CDRL3-14 |
| 57A4 | CDRL1-37 | CDRL2-29 | CDRL3-14 |
| 57F9 | CDRL1-37 | CDRL2-29 | CDRL3-14 |
| 51G2 | CDRL1-14 | CDRL2-13 | CDRL3-14 |
| 56A7 | CDRL1-29 | CDRL2-24 | CDRL3-14 |
| 56E4 | CDRL1-29 | CDRL2-24 | CDRL3-14 |
| 54H10.1 | CDRL1-25 | CDRL2-20 | CDRL3-24 |
| 55D1 | CDRL1-25 | CDRL2-20 | CDRL3-24 |
| 48H3 | CDRL1-25 | CDRL2-20 | CDRL3-24 |
| 53C11 | CDRL1-25 | CDRL2-20 | CDRL3-24 |
| 59G10.3 | CDRL1-41 | CDRL2-16 | CDRL3-37 |
| 51C10.1 | CDRL1-12 | CDRL2-10 | CDRL3-11 |
| 59D10 v1 | CDRL1-38 | CDRL2-10 | CDRL3-34 |
| 59D10 v2 | CDRL1-39 | CDRL2-30 | CDRL3-35 |
| 60F9 | CDRL1-43 | CDRL2-31 | CDRL3-39 |
| 48B4 | CDRL1-43 | CDRL2-31 | CDRL3-39 |
| 52D6 | CDRL1-43 | CDRL2-31 | CDRL3-39 |
| 61G5 | CDRL1-45 | CDRL2-33 | CDRL3-39 |
| 59G10.2 | CDRL1-40 | CDRL2-11 | CDRL3-36 |
| 51A8 | CDRL1-10 | CDRL2-9 | CDRL3-10 |
| 53H5.2 | CDRL1-22 | CDRL2-14 | CDRL3-22 |
| 53F6 | CDRL1-21 | CDRL2-19 | CDRL3-21 |
| 56C11 | CDRL1-30 | CDRL2-25 | CDRL3-28 |
| 49A10 | CDRL1-5 | CDRL2-5 | CDRL3-5 |
| 48D4 | CDRL1-5 | CDRL2-5 | CDRL3-5 |
| 49G2 | CDRL1-7 | CDRL2-5 | CDRL3-7 |
| 50C12 | CDRL1-7 | CDRL2-5 | CDRL3-7 |
| 55G11 | CDRL1-7 | CDRL2-5 | CDRL3-7 |
| 52C1 | CDRL1-17 | CDRL2-16 | CDRL3-17 |
| 55E9 | CDRL1-27 | CDRL2-17 | CDRL3-26 |
| 60D7 | CDRL1-1 | CDRL2-5 | CDRL3-38 |
| 51C10.2 | CDRL1-12 | CDRL2-11 | CDRL3-12 |
| 55D3 | CDRL1-26 | CDRL2-14 | CDRL3-25 |
| 57B12 | CDRL1-34 | CDRL2-14 | CDRL3-32 |
| 52C5 | CDRL1-18 | CDRL2-14 | CDRL3-18 |
| 55E4 | CDRL1-18 | CDRL2-21 | CDRL3-18 |
| 49B11 | CDRL1-18 | CDRL2-21 | CDRL3-18 |
| 50H10 | CDRL1-18 | CDRL2-21 | CDRL3-18 |
| 53C1 | CDRL1-18 | CDRL2-21 | CDRL3-18 |
| 56G1 | CDRL1-18 | CDRL2-14 | CDRL3-30 |
| 48F3 | CDRL1-2 | CDRL2-2 | CDRL3-2 |
| 48C9 | CDRL1-1 | CDRL2-1 | CDRL3-1 |
| 49A12 | CDRL1-1 | CDRL2-1 | CDRL3-1 |
| 51E2 | CDRL1-1 | CDRL2-1 | CDRL3-1 |
| 51E5 | CDRL1-13 | CDRL2-12 | CDRL3-13 |
| 53H5.3 | CDRL1-23 | CDRL2-15 | CDRL3-23 |
| 56G3.3 | CDRL1-33 | CDRL2-27 | CDRL3-31 |
| 55B10 | CDRL1-33 | CDRL2-27 | CDRL3-31 |
| 52B8 | CDRL1-16 | CDRL2-15 | CDRL3-16 |
| 55G5 | CDRL1-28 | CDRL2-23 | CDRL3-27 |
| 52H2 | CDRL1-20 | CDRL2-18 | CDRL3-20 |
| 56G3.2 | CDRL1-32 | CDRL2-26 | CDRL3-16 |
| 56E7 | CDRL1-31 | CDRL2-7 | CDRL3-29 |
| 57D9 | CDRL1-35 | CDRL2-20 | CDRL3-31 |
| 61H5 | CDRL1-33 | CDRL2-20 | CDRL3-31 |
| 52B9 | CDRL1-33 | CDRL2-20 | CDRL3-31 |
| 48G4 | CDRL1-79 | CDRL2-35 | CDRL3-71 |
| 53C3.1 | CDRL1-79 | CDRL2-35 | CDRL3-71 |
| 50G1 | CDRL1-7 | CDRL2-5 | CDRL3-38 |
| 58C2 | CDRL1-81 | CDRL2-5 | CDRL3-66 |
| 60G5.1 | CDRL1-18 | CDRL2-14 | CDRL3-18 |
| 54H10.3 | CDRL1-42 | CDRL2-46 | CDRL3-53 |
| 50G5 v1 | CDRL1-22 | CDRL2-14 | CDRL3-72 |
| 50G5 v2 | CDRL1-78 | CDRL2-22 | CDRL3-75 |
| 51C1 | CDRL1-18 | CDRL2-14 | CDRL3-18 |
| 53C3.2 | CDRL1-36 | CDRL2-44 | CDRL3-70 |
| 50D4 | CDRL1-26 | CDRL2-53 | CDRL3-74 |
| 55A7 | CDRL1-58 | CDRL2-14 | CDRL3-54 |
| 55E6 | CDRL1-64 | CDRL2-20 | CDRL3-65 |
| 61E1 | CDRL1-68 | CDRL2-14 | CDRL3-67 |
| 63H11 | CDRL1-46 | CDRL2-34 | CDRL3-42 |

In an additional aspect, an antigen binding protein includes the following associations of CDRH1, CDRH2 and CDRH3, presented for convenience in tablular form and in reference to the clone source of the association:

TABLE 5

CDRH Associations

| Clone ID | CDRH1 | CDRH2 | CDRH3 |
| --- | --- | --- | --- |
| 63G8 | CDRH1-34 | CDRH2-12 | CDRH3-50 |
| 64A8 | CDRH1-34 | CDRH2-12 | CDRH3-50 |
| 67B4 | CDRH1-34 | CDRH2-12 | CDRH3-50 |
| 68D3 | CDRH1-34 | CDRH2-12 | CDRH3-50 |
| 64E6 | CDRH1-35 | CDRH2-44 | CDRH3-51 |
| 65E8 | CDRH1-35 | CDRH2-44 | CDRH3-51 |
| 65F11 | CDRH1-35 | CDRH2-44 | CDRH3-51 |
| 67G7 | CDRH1-35 | CDRH2-44 | CDRH3-51 |
| 63B6 | CDRH1-36 | CDRH2-45 | CDRH3-52 |
| 64D4 | CDRH1-36 | CDRH2-45 | CDRH3-52 |
| 65C3 | CDRH1-24 | CDRH2-46 | CDRH3-53 |
| 68D5 | CDRH1-24 | CDRH2-46 | CDRH3-53 |
| 63E6 | CDRH1-37 | CDRH2-47 | CDRH3-54 |
| 66F7 | CDRH1-37 | CDRH2-47 | CDRH3-54 |
| 64H5 | CDRH1-12 | CDRH2-48 | CDRH3-55 |
| 65G4 | CDRH1-12 | CDRH2-48 | CDRH3-55 |
| 67G10v1 | CDRH1-38 | CDRH2-49 | CDRH3-56 |
| 67G10v2 | CDRH1-38 | CDRH2-49 | CDRH3-56 |
| 66B4 | CDRH1-15 | CDRH2-53 | CDRH3-59 |
| 66G2 | CDRH1-12 | CDRH2-54 | CDRH3-50 |
| 68G5 | CDRH1-12 | CDRH2-55 | CDRH3-60 |
| 63F5 | CDRH1-35 | CDRH2-50 | CDRH3-51 |
| 66F6 | CDRH1-35 | CDRH2-34 | CDRH3-51 |
| 65C1 | CDRH1-35 | CDRH2-52 | CDRH3-58 |
| 64A7 | CDRH1-40 | CDRH2-51 | CDRH3-57 |
| 66D4 | CDRH1-43 | CDRH2-56 | CDRH3-61 |
| 65B1 | CDRH1-44 | CDRH2-57 | CDRH3-62 |
| 67A4 | CDRH1-45 | CDRH2-58 | CDRH3-63 |
| 65B4 | CDRH1-46 | CDRH2-59 | CDRH3-64 |
| 63A10 | CDRH1-38 | CDRH2-60 | CDRH3-56 |
| 65H11 | CDRH1-38 | CDRH2-61 | CDRH3-56 |
| 64C8 | CDRH1-12 | CDRH2-62 | CDRH3-65 |
| 65E3 | CDRH1-47 | CDRH2-63 | CDRH3-66 |
| 65D4 | CDRH1-48 | CDRH2-22 | CDRH3-67 |
| 65D1 | CDRH1-49 | CDRH2-64 | CDRH3-68 |
| 67G8 | CDRH1-12 | CDRH2-65 | CDRH3-69 |
| 65B7 | CDRH1-50 | CDRH2-52 | CDRH3-70 |
| 64A6 | CDRH1-14 | CDRH2-66 | CDRH3-71 |
| 65F9 | CDRH1-36 | CDRH2-34 | CDRH3-72 |
| 67F5 | CDRH1-24 | CDRH2-67 | CDRH3-53 |
| 64B10 | CDRH1-36 | CDRH2-68 | CDRH3-73 |
| 68C8 | CDRH1-51 | CDRH2-69 | CDRH3-74 |
| 67A5 | CDRH1-25 | CDRH2-31 | CDRH3-75 |
| 67C10 | CDRH1-25 | CDRH2-31 | CDRH3-76 |
| 64H6 | CDRH1-25 | CDRH2-70 | CDRH3-77 |
| 63F9 | CDRH1-52 | CDRH2-71 | CDRH3-78 |
| 67F6 | CDRH1-53 | CDRH2-31 | CDRH3-79 |
| 48H11 | CDRH1-4 | CDRH2-4 | CDRH3-4 |
| 52A8 | CDRH1-15 | CDRH2-17 | CDRH3-17 |
| 52F8 | CDRH1-17 | CDRH2-20 | CDRH3-21 |
| 49H12 | CDRH1-10 | CDRH2-10 | CDRH3-10 |
| 54A1 | CDRH1-10 | CDRH2-25 | CDRH3-10 |
| 55G9 | CDRH1-10 | CDRH2-25 | CDRH3-10 |
| 49C8 | CDRH1-7 | CDRH2-7 | CDRH3-7 |

TABLE 5-continued

CDRH Associations

| Clone ID | CDRH1 | CDRH2 | CDRH3 |
|---|---|---|---|
| 52H1 | CDRH1-7 | CDRH2-7 | CDRH3-7 |
| 60G5.2 | CDRH1-33 | CDRH2-42 | CDRH3-48 |
| 49G3 | CDRH1-9 | CDRH2-9 | CDRH3-9 |
| 59A10 | CDRH1-30 | CDRH2-37 | CDRH3-41 |
| 49H4 | CDRH1-30 | CDRH2-37 | CDRH3-41 |
| 48F8 | CDRH1-3 | CDRH2-3 | CDRH3-3 |
| 53B9 | CDRH1-3 | CDRH2-3 | CDRH3-3 |
| 56B4 | CDRH1-3 | CDRH2-3 | CDRH3-3 |
| 57E7 | CDRH1-3 | CDRH2-3 | CDRH3-3 |
| 57F11 | CDRH1-3 | CDRH2-3 | CDRH3-3 |
| 59C9 | CDRH1-31 | CDRH2-38 | CDRH3-42 |
| 58A5 | CDRH1-31 | CDRH2-38 | CDRH3-42 |
| 57A4 | CDRH1-31 | CDRH2-38 | CDRH3-42 |
| 57F9 | CDRH1-31 | CDRH2-38 | CDRH3-42 |
| 51G2 | CDRH1-3 | CDRH2-16 | CDRH3-16 |
| 56A7 | CDRH1-3 | CDRH2-16 | CDRH3-32 |
| 56E4 | CDRH1-3 | CDRH2-16 | CDRH3-32 |
| 54H10.1 | CDRH1-21 | CDRH2-26 | CDRH3-27 |
| 55D1 | CDRH1-21 | CDRH2-26 | CDRH3-27 |
| 48H3 | CDRH1-21 | CDRH2-26 | CDRH3-27 |
| 53C11 | CDRH1-21 | CDRH2-26 | CDRH3-27 |
| 59G10.3 | CDRH1-32 | CDRH2-40 | CDRH3-45 |
| 51C10.1 | CDRH1-13 | CDRH2-13 | CDRH3-13 |
| 59D10 v1 | CDRH1-13 | CDRH2-13 | CDRH3-13 |
| 59D10 v2 | CDRH1-13 | CDRH2-13 | CDRH3-13 |
| 60F9 | CDRH1-21 | CDRH2-41 | CDRH3-47 |
| 48B4 | CDRH1-21 | CDRH2-41 | CDRH3-47 |
| 52D6 | CDRH1-21 | CDRH2-41 | CDRH3-47 |
| 61G5 | CDRH1-21 | CDRH2-43 | CDRH3-49 |
| 59G10.2 | CDRH1-6 | CDRH2-39 | CDRH3-44 |
| 51A8 | CDRH1-12 | CDRH2-12 | CDRH3-12 |
| 53H5.2 | CDRH1-12 | CDRH2-23 | CDRH3-24 |
| 53F6 | CDRH1-19 | CDRH2-22 | CDRH3-23 |
| 56C11 | CDRH1-12 | CDRH2-30 | CDRH3-33 |
| 49A10 | CDRH1-6 | CDRH2-6 | CDRH3-6 |
| 48D4 | CDRH1-6 | CDRH2-6 | CDRH3-6 |
| 49G2 | CDRH1-8 | CDRH2-8 | CDRH3-8 |
| 50C12 | CDRH1-8 | CDRH2-8 | CDRH3-8 |
| 55G11 | CDRH1-8 | CDRH2-8 | CDRH3-8 |
| 52C1 | CDRH1-12 | CDRH2-19 | CDRH3-19 |
| 55E9 | CDRH1-23 | CDRH2-28 | CDRH3-30 |
| 60D7 | CDRH1-12 | CDRH2-22 | CDRH3-46 |
| 51C10.2 | CDRH1-14 | CDRH2-14 | CDRH3-14 |
| 55D3 | CDRH1-22 | CDRH2-27 | CDRH3-28 |
| 57B12 | CDRH1-28 | CDRH2-34 | CDRH3-28 |
| 52C5 | CDRH1-2 | CDRH2-1 | CDRH3-20 |
| 60G5.1 | CDRH1-2 | CDRH2-1 | CDRH3-20 |
| 55E4 | CDRH1-2 | CDRH2-1 | CDRH3-20 |
| 49B11 | CDRH1-2 | CDRH2-1 | CDRH3-20 |
| 50H10 | CDRH1-2 | CDRH2-1 | CDRH3-20 |
| 53C1 | CDRH1-2 | CDRH2-1 | CDRH3-20 |
| 56G1 | CDRH1-2 | CDRH2-1 | CDRH3-20 |
| 48F3 | CDRH1-2 | CDRH2-2 | CDRH3-2 |
| 48C9 | CDRH1-1 | CDRH2-1 | CDRH3-1 |
| 49A12 | CDRH1-1 | CDRH2-1 | CDRH3-1 |
| 51E2 | CDRH1-1 | CDRH2-1 | CDRH3-1 |
| 51E5 | CDRH1-2 | CDRH2-15 | CDRH3-15 |
| 53H5.3 | CDRH1-20 | CDRH2-24 | CDRH3-25 |
| 56G3.3 | CDRH1-27 | CDRH2-33 | CDRH3-37 |
| 55B10 | CDRH1-27 | CDRH2-33 | CDRH3-37 |
| 52B8 | CDRH1-16 | CDRH2-18 | CDRH3-18 |
| 55G5 | CDRH1-24 | CDRH2-29 | CDRH3-31 |
| 52H2 | CDRH1-18 | CDRH2-21 | CDRH3-22 |
| 56G3.2 | CDRH1-26 | CDRH2-32 | CDRH3-36 |
| 56E7 | CDRH1-25 | CDRH2-31 | CDRH3-34 |
| 57D9 | CDRH1-29 | CDRH2-35 | CDRH3-39 |
| 48G4 | CDRH1-5 | CDRH2-5 | CDRH3-5 |
| 53C3.1 | CDRH1-5 | CDRH2-5 | CDRH3-5 |
| 50G1 | CDRH1-11 | CDRH2-11 | CDRH3-11 |
| 58C2 | CDRH1-6 | CDRH2-36 | CDRH3-40 |
| 63H11 | CDRH1-35 | CDRH2-34 | CDRH3-51 |
| 61H5 | CDRH1-27 | CDRH2-72 | CDRH3-37 |
| 52B9 | CDRH1-27 | CDRH2-72 | CDRH3-37 |
| 54H10.3 | CDRH1-43 | CDRH2-74 | CDRH3-81 |
| 50G5 v1 | CDRH1-37 | CDRH2-73 | CDRH3-35 |
| 50G5 v2 | CDRH1-37 | CDRH2-73 | CDRH3-35 |
| 51C1 | CDRH1-2 | CDRH2-1 | CDRH3-20 |
| 53C3.2 | CDRH1-39 | CDRH2-77 | CDRH3-43 |
| 50D4 | CDRH1-41 | CDRH2-75 | CDRH3-80 |
| 55A7 | CDRH1-24 | CDRH2-18 | CDRH3-38 |
| 55E6 | CDRH1-3 | CDRH2-76 | CDRH3-29 |
| 61E1 | CDRH1-42 | CDRH2-35 | CDRH3-26 |

In an additional aspect, an antigen binding protein includes the following associations of CDRH1, CDRH2, CDRH3, CDRL1, CDRL2 and CDRL3 presented for convenience in tablular form and in reference to the clone source of the association:

TABLE 6

CDRH and CDRL Associations

| Clone ID | CDRL1 | CDRL2 | CDRL3 | CDRH1 | CDRH2 | CDRH3 |
|---|---|---|---|---|---|---|
| 63G8 | CDRL1-13 | CDRL2-29 | CDRL3-41 | CDRH1-34 | CDRH2-12 | CDRH3-50 |
| 64A8 | CDRL1-13 | CDRL2-29 | CDRL3-41 | CDRH1-34 | CDRH2-12 | CDRH3-50 |
| 67B4 | CDRL1-13 | CDRL2-29 | CDRL3-41 | CDRH1-34 | CDRH2-12 | CDRH3-50 |
| 68D3 | CDRL1-13 | CDRL2-29 | CDRL3-41 | CDRH1-34 | CDRH2-12 | CDRH3-50 |
| 64E6 | CDRL1-46 | CDRL2-34 | CDRL3-42 | CDRH1-35 | CDRH2-44 | CDRH3-51 |
| 65E8 | CDRL1-46 | CDRL2-34 | CDRL3-42 | CDRH1-35 | CDRH2-44 | CDRH3-51 |
| 65F11 | CDRL1-46 | CDRL2-34 | CDRL3-42 | CDRH1-35 | CDRH2-44 | CDRH3-51 |
| 67G7 | CDRL1-46 | CDRL2-34 | CDRL3-42 | CDRH1-35 | CDRH2-44 | CDRH3-51 |
| 63B6 | CDRL1-47 | CDRL2-3 | CDRL3-43 | CDRH1-36 | CDRH2-45 | CDRH3-52 |
| 64D4 | CDRL1-47 | CDRL2-3 | CDRL3-43 | CDRH1-36 | CDRH2-45 | CDRH3-52 |
| 65C3 | CDRL1-48 | CDRL2-36 | CDRL3-44 | CDRH1-24 | CDRH2-46 | CDRH3-53 |
| 68D5 | CDRL1-48 | CDRL2-36 | CDRL3-44 | CDRH1-24 | CDRH2-46 | CDRH3-53 |
| 63E6 | CDRL1-49 | CDRL2-14 | CDRL3-45 | CDRH1-37 | CDRH2-47 | CDRH3-54 |
| 66F7 | CDRL1-50 | CDRL2-14 | CDRL3-45 | CDRH1-37 | CDRH2-47 | CDRH3-54 |
| 64H5 | CDRL1-51 | CDRL2-37 | CDRL3-46 | CDRH1-12 | CDRH2-48 | CDRH3-55 |
| 65G4 | CDRL1-51 | CDRL2-37 | CDRL3-46 | CDRH1-12 | CDRH2-48 | CDRH3-55 |
| 67G10v1 | CDRL1-52 | CDRL2-38 | CDRL3-47 | CDRH1-38 | CDRH2-49 | CDRH3-56 |
| 67G10v2 | CDRL1-53 | CDRL2-39 | CDRL3-48 | CDRH1-38 | CDRH2-49 | CDRH3-56 |
| 66B4 | CDRL1-57 | CDRL2-40 | CDRL3-50 | CDRH1-15 | CDRH2-53 | CDRH3-59 |
| 66G2 | CDRL1-22 | CDRL2-41 | CDRL3-51 | CDRH1-12 | CDRH2-54 | CDRH3-50 |
| 68G5 | CDRL1-59 | CDRL2-42 | CDRL3-52 | CDRH1-12 | CDRH2-55 | CDRH3-60 |
| 63F5 | CDRL1-54 | CDRL2-20 | CDRL3-42 | CDRH1-35 | CDRH2-50 | CDRH3-51 |
| 66F6 | CDRL1-46 | CDRL2-35 | CDRL3-42 | CDRH1-35 | CDRH2-34 | CDRH3-51 |

TABLE 6-continued

CDRH and CDRL Associations

| Clone ID | CDRL1 | CDRL2 | CDRL3 | CDRH1 | CDRH2 | CDRH3 |
|---|---|---|---|---|---|---|
| 65C1 | CDRL1-56 | CDRL2-35 | CDRL3-42 | CDRH1-35 | CDRH2-52 | CDRH3-58 |
| 64A7 | CDRL1-55 | CDRL2-20 | CDRL3-49 | CDRH1-40 | CDRH2-51 | CDRH3-57 |
| 66D4 | CDRL1-60 | CDRL2-14 | CDRL3-53 | CDRH1-43 | CDRH2-56 | CDRH3-61 |
| 65B1 | CDRL1-61 | CDRL2-43 | CDRL3-15 | CDRH1-44 | CDRH2-57 | CDRH3-62 |
| 67A4 | CDRL1-62 | CDRL2-25 | CDRL3-55 | CDRH1-45 | CDRH2-58 | CDRH3-63 |
| 65B4 | CDRL1-63 | CDRL2-25 | CDRL3-55 | CDRH1-46 | CDRH2-59 | CDRH3-64 |
| 63A10 | CDRL1-52 | CDRL2-45 | CDRL3-56 | CDRH1-38 | CDRH2-60 | CDRH3-56 |
| 65H11 | CDRL1-65 | CDRL2-38 | CDRL3-57 | CDRH1-38 | CDRH2-61 | CDRH3-56 |
| 64C8 | CDRL1-66 | CDRL2-47 | CDRL3-58 | CDRH1-12 | CDRH2-62 | CDRH3-65 |
| 65E3 | CDRL1-51 | CDRL2-42 | CDRL3-59 | CDRH1-47 | CDRH2-63 | CDRH3-66 |
| 65D4 | CDRL1-67 | CDRL2-42 | CDRL3-60 | CDRH1-48 | CDRH2-22 | CDRH3-67 |
| 65D1 | CDRL1-39 | CDRL2-32 | CDRL3-61 | CDRH1-49 | CDRH2-64 | CDRH3-68 |
| 67G8 | CDRL1-69 | CDRL2-37 | CDRL3-59 | CDRH1-12 | CDRH2-65 | CDRH3-69 |
| 65B7 | CDRL1-70 | CDRL2-20 | CDRL3-62 | CDRH1-50 | CDRH2-52 | CDRH3-70 |
| 64A6 | CDRL1-71 | CDRL2-48 | CDRL3-63 | CDRH1-14 | CDRH2-66 | CDRH3-71 |
| 65F9 | CDRL1-72 | CDRL2-15 | CDRL3-63 | CDRH1-36 | CDRH2-34 | CDRH3-72 |
| 67F5 | CDRL1-72 | CDRL2-49 | CDRL3-64 | CDRH1-24 | CDRH2-67 | CDRH3-53 |
| 64B10 | CDRL1-73 | CDRL2-50 | CDRL3-17 | CDRH1-36 | CDRH2-68 | CDRH3-73 |
| 68C8 | CDRL1-74 | CDRL2-16 | CDRL3-17 | CDRH1-51 | CDRH2-69 | CDRH3-74 |
| 67A5 | CDRL1-75 | CDRL2-5 | CDRL3-66 | CDRH1-25 | CDRH2-31 | CDRH3-75 |
| 67C10 | CDRL1-75 | CDRL2-5 | CDRL3-5 | CDRH1-25 | CDRH2-31 | CDRH3-76 |
| 64H6 | CDRL1-51 | CDRL2-37 | CDRL3-68 | CDRH1-25 | CDRH2-70 | CDRH3-77 |
| 63F9 | CDRL1-76 | CDRL2-51 | CDRL3-69 | CDRH1-52 | CDRH2-71 | CDRH3-78 |
| 67F6 | CDRL1-77 | CDRL2-52 | CDRL3-5 | CDRH1-53 | CDRH2-31 | CDRH3-79 |
| 48H11 | CDRL1-4 | CDRL2-4 | CDRL3-4 | CDRH1-4 | CDRH2-4 | CDRH3-4 |
| 52A8 | CDRL1-15 | CDRL2-14 | CDRL3-15 | CDRH1-15 | CDRH2-17 | CDRH3-17 |
| 52F8 | CDRL1-19 | CDRL2-17 | CDRL3-19 | CDRH1-17 | CDRH2-20 | CDRH3-21 |
| 49H12 | CDRL1-9 | CDRL2-8 | CDRL3-9 | CDRH1-10 | CDRH2-10 | CDRH3-10 |
| 54A1 | CDRL1-24 | CDRL2-6 | CDRL3-9 | CDRH1-10 | CDRH2-25 | CDRH3-10 |
| 55G9 | CDRL1-24 | CDRL2-6 | CDRL3-9 | CDRH1-10 | CDRH2-25 | CDRH3-10 |
| 49C8 | CDRL1-6 | CDRL2-6 | CDRL3-6 | CDRH1-7 | CDRH2-7 | CDRH3-7 |
| 52H1 | CDRL1-6 | CDRL2-6 | CDRL3-6 | CDRH1-7 | CDRH2-7 | CDRH3-7 |
| 60G5.2 | CDRL1-44 | CDRL2-32 | CDRL3-40 | CDRH1-33 | CDRH2-42 | CDRH3-48 |
| 49G3 | CDRL1-8 | CDRL2-7 | CDRL3-8 | CDRH1-9 | CDRH2-9 | CDRH3-9 |
| 59A10 | CDRL1-14 | CDRL2-28 | CDRL3-14 | CDRH1-30 | CDRH2-37 | CDRH3-41 |
| 49H4 | CDRL1-14 | CDRL2-28 | CDRL3-14 | CDRH1-30 | CDRH2-37 | CDRH3-41 |
| 48F8 | CDRL1-3 | CDRL2-3 | CDRL3-3 | CDRH1-3 | CDRH2-3 | CDRH3-3 |
| 53B9 | CDRL1-3 | CDRL2-3 | CDRL3-3 | CDRH1-3 | CDRH2-3 | CDRH3-3 |
| 56B4 | CDRL1-3 | CDRL2-3 | CDRL3-3 | CDRH1-3 | CDRH2-3 | CDRH3-3 |
| 57E7 | CDRL1-3 | CDRL2-3 | CDRL3-3 | CDRH1-3 | CDRH2-3 | CDRH3-3 |
| 57F11 | CDRL1-3 | CDRL2-3 | CDRL3-3 | CDRH1-3 | CDRH2-3 | CDRH3-3 |
| 59C9 | CDRL1-37 | CDRL2-29 | CDRL3-14 | CDRH1-31 | CDRH2-38 | CDRH3-42 |
| 58A5 | CDRL1-37 | CDRL2-29 | CDRL3-14 | CDRH1-31 | CDRH2-38 | CDRH3-42 |
| 57A4 | CDRL1-37 | CDRL2-29 | CDRL3-14 | CDRH1-31 | CDRH2-38 | CDRH3-42 |
| 57F9 | CDRL1-37 | CDRL2-29 | CDRL3-14 | CDRH1-31 | CDRH2-38 | CDRH3-42 |
| 51G2 | CDRL1-14 | CDRL2-13 | CDRL3-14 | CDRH1-3 | CDRH2-16 | CDRH3-16 |
| 56A7 | CDRL1-29 | CDRL2-24 | CDRL3-14 | CDRH1-3 | CDRH2-16 | CDRH3-32 |
| 56E4 | CDRL1-29 | CDRL2-24 | CDRL3-14 | CDRH1-3 | CDRH2-16 | CDRH3-32 |
| 54H10.1 | CDRL1-25 | CDRL2-20 | CDRL3-24 | CDRH1-21 | CDRH2-26 | CDRH3-27 |
| 55D1 | CDRL1-25 | CDRL2-20 | CDRL3-24 | CDRH1-21 | CDRH2-26 | CDRH3-27 |
| 48H3 | CDRL1-25 | CDRL2-20 | CDRL3-24 | CDRH1-21 | CDRH2-26 | CDRH3-27 |
| 53C11 | CDRL1-25 | CDRL2-20 | CDRL3-24 | CDRH1-21 | CDRH2-26 | CDRH3-27 |
| 59G10.3 | CDRL1-41 | CDRL2-16 | CDRL3-37 | CDRH1-32 | CDRH2-40 | CDRH3-45 |
| 51C10.1 | CDRL1-12 | CDRL2-10 | CDRL3-11 | CDRH1-13 | CDRH2-13 | CDRH3-13 |
| 59D10 v1 | CDRL1-38 | CDRL2-10 | CDRL3-34 | CDRH1-13 | CDRH2-13 | CDRH3-13 |
| 59D10 v2 | CDRL1-39 | CDRL2-30 | CDRL3-35 | CDRH1-13 | CDRH2-13 | CDRH3-13 |
| 60F9 | CDRL1-43 | CDRL2-31 | CDRL3-39 | CDRH1-21 | CDRH2-41 | CDRH3-47 |
| 48B4 | CDRL1-43 | CDRL2-31 | CDRL3-39 | CDRH1-21 | CDRH2-41 | CDRH3-47 |
| 52D6 | CDRL1-43 | CDRL2-31 | CDRL3-39 | CDRH1-21 | CDRH2-41 | CDRH3-47 |
| 61G5 | CDRL1-45 | CDRL2-33 | CDRL3-39 | CDRH1-21 | CDRH2-43 | CDRH3-49 |
| 59G10.2 | CDRL1-40 | CDRL2-11 | CDRL3-36 | CDRH1-6 | CDRH2-39 | CDRH3-44 |
| 51A8 | CDRL1-10 | CDRL2-9 | CDRL3-10 | CDRH1-12 | CDRH2-12 | CDRH3-12 |
| 53H5.2 | CDRL1-22 | CDRL2-14 | CDRL3-22 | CDRH1-12 | CDRH2-23 | CDRH3-24 |
| 53F6 | CDRL1-21 | CDRL2-19 | CDRL3-21 | CDRH1-19 | CDRH2-22 | CDRH3-23 |
| 56C11 | CDRL1-30 | CDRL2-25 | CDRL3-28 | CDRH1-12 | CDRH2-30 | CDRH3-33 |
| 49A10 | CDRL1-5 | CDRL2-5 | CDRL3-5 | CDRH1-6 | CDRH2-6 | CDRH3-6 |
| 48D4 | CDRL1-5 | CDRL2-5 | CDRL3-5 | CDRH1-6 | CDRH2-6 | CDRH3-6 |
| 49G2 | CDRL1-7 | CDRL2-5 | CDRL3-7 | CDRH1-8 | CDRH2-8 | CDRH3-8 |
| 50C12 | CDRL1-7 | CDRL2-5 | CDRL3-7 | CDRH1-8 | CDRH2-8 | CDRH3-8 |
| 55G11 | CDRL1-7 | CDRL2-5 | CDRL3-7 | CDRH1-8 | CDRH2-8 | CDRH3-8 |
| 52C1 | CDRL1-17 | CDRL2-16 | CDRL3-17 | CDRH1-12 | CDRH2-19 | CDRH3-19 |
| 55E9 | CDRL1-27 | CDRL2-17 | CDRL3-26 | CDRH1-23 | CDRH2-28 | CDRH3-30 |
| 60D7 | CDRL1-1 | CDRL2-5 | CDRL3-38 | CDRH1-12 | CDRH2-22 | CDRH3-46 |
| 51C10.2 | CDRL1-12 | CDRL2-11 | CDRL3-12 | CDRH1-14 | CDRH2-14 | CDRH3-14 |

TABLE 6-continued

CDRH and CDRL Associations

| Clone ID | CDRL1 | CDRL2 | CDRL3 | CDRH1 | CDRH2 | CDRH3 |
|---|---|---|---|---|---|---|
| 55D3 | CDRL1-26 | CDRL2-14 | CDRL3-25 | CDRH1-22 | CDRH2-27 | CDRH3-28 |
| 57B12 | CDRL1-34 | CDRL2-14 | CDRL3-32 | CDRH1-28 | CDRH2-34 | CDRH3-28 |
| 52C5 | CDRL1-18 | CDRL2-14 | CDRL3-18 | CDRH1-2 | CDRH2-1 | CDRH3-20 |
| 60G5.1 | CDRL1-18 | CDRL2-14 | CDRL3-18 | CDRH1-2 | CDRH2-1 | CDRH3-20 |
| 55E4 | CDRL1-18 | CDRL2-21 | CDRL3-18 | CDRH1-2 | CDRH2-1 | CDRH3-20 |
| 49B11 | CDRL1-18 | CDRL2-21 | CDRL3-18 | CDRH1-2 | CDRH2-1 | CDRH3-20 |
| 50H10 | CDRL1-18 | CDRL2-21 | CDRL3-18 | CDRH1-2 | CDRH2-1 | CDRH3-20 |
| 53C1 | CDRL1-18 | CDRL2-21 | CDRL3-18 | CDRH1-2 | CDRH2-1 | CDRH3-20 |
| 56G1 | CDRL1-18 | CDRL2-14 | CDRL3-30 | CDRH1-2 | CDRH2-1 | CDRH3-20 |
| 48F3 | CDRL1-2 | CDRL2-2 | CDRL3-2 | CDRH1-2 | CDRH2-2 | CDRH3-2 |
| 48C9 | CDRL1-1 | CDRL2-1 | CDRL3-1 | CDRH1-1 | CDRH2-1 | CDRH3-1 |
| 49A12 | CDRL1-1 | CDRL2-1 | CDRL3-1 | CDRH1-1 | CDRH2-1 | CDRH3-1 |
| 51E2 | CDRL1-1 | CDRL2-1 | CDRL3-1 | CDRH1-1 | CDRH2-1 | CDRH3-1 |
| 51E5 | CDRL1-13 | CDRL2-12 | CDRL3-13 | CDRH1-2 | CDRH2-15 | CDRH3-15 |
| 53H5.3 | CDRL1-23 | CDRL2-15 | CDRL3-23 | CDRH1-20 | CDRH2-24 | CDRH3-25 |
| 56G3.3 | CDRL1-33 | CDRL2-27 | CDRL3-31 | CDRH1-27 | CDRH2-33 | CDRH3-37 |
| 55B10 | CDRL1-33 | CDRL2-27 | CDRL3-31 | CDRH1-27 | CDRH2-33 | CDRH3-37 |
| 52B8 | CDRL1-16 | CDRL2-15 | CDRL3-16 | CDRH1-16 | CDRH2-18 | CDRH3-18 |
| 55G5 | CDRL1-28 | CDRL2-23 | CDRL3-27 | CDRH1-24 | CDRH2-29 | CDRH3-31 |
| 52H2 | CDRL1-20 | CDRL2-18 | CDRL3-20 | CDRH1-18 | CDRH2-21 | CDRH3-22 |
| 56G3.2 | CDRL1-32 | CDRL2-26 | CDRL3-16 | CDRH1-26 | CDRH2-32 | CDRH3-36 |
| 56E7 | CDRL1-31 | CDRL2-7 | CDRL3-29 | CDRH1-25 | CDRH2-31 | CDRH3-34 |
| 57D9 | CDRL1-35 | CDRL2-20 | CDRL3-33 | CDRH1-29 | CDRH2-35 | CDRH3-39 |
| 61H5 | CDRL1-33 | CDRL2-20 | CDRL3-31 | CDRH1-27 | CDRH2-72 | CDRH3-37 |
| 52B9 | CDRL1-33 | CDRL2-20 | CDRL3-31 | CDRH1-27 | CDRH2-72 | CDRH3-37 |
| 48G4 | CDRL1-79 | CDRL2-35 | CDRL3-71 | CDRH1-5 | CDRH2-5 | CDRH3-5 |
| 53C3.1 | CDRL1-79 | CDRL2-35 | CDRL3-71 | CDRH1-5 | CDRH2-5 | CDRH3-5 |
| 50G1 | CDRL1-7 | CDRL2-5 | CDRL3-38 | CDRH1-11 | CDRH2-11 | CDRH3-11 |
| 58C2 | CDRL1-81 | CDRL2-5 | CDRL3-66 | CDRH1-6 | CDRH2-36 | CDRH3-40 |
| 54H10.3 | CDRL1-42 | CDRL2-46 | CDRL3-53 | CDRH1-43 | CDRH2-74 | CDRH3-81 |
| 50G5 v1 | CDRL1-22 | CDRL2-14 | CDRL3-72 | CDRH1-37 | CDRH2-73 | CDRH3-35 |
| 50G5 v2 | CDRL1-78 | CDRL2-22 | CDRL3-75 | CDRH1-37 | CDRH2-73 | CDRH3-35 |
| 51C1 | CDRL1-18 | CDRL2-14 | CDRL3-18 | CDRH1-2 | CDRH2-1 | CDRH3-20 |
| 53C3.2 | CDRL1-36 | CDRL2-44 | CDRL3-70 | CDRH1-39 | CDRH2-77 | CDRH3-43 |
| 50D4 | CDRL1-26 | CDRL2-53 | CDRL3-74 | CDRH1-41 | CDRH2-75 | CDRH3-80 |
| 55A7 | CDRL1-58 | CDRL2-14 | CDRL3-54 | CDRH1-24 | CDRH2-18 | CDRH3-38 |
| 55E6 | CDRL1-64 | CDRL2-20 | CDRL3-65 | CDRH1-3 | CDRH2-76 | CDRH3-29 |
| 61E1 | CDRL1-68 | CDRL2-14 | CDRL3-67 | CDRH1-42 | CDRH2-35 | CDRH3-26 |
| 63H11 | CDRL1-46 | CDRL2-34 | CDRL3-42 | CDRH1-35 | CDRH2-34 | CDRH3-51 |

Consensus Sequences

In yet another aspect, the CDRs disclosed herein include consensus sequences derived from groups of related monoclonal antibodies. As described herein, a "consensus sequence" refers to amino acid sequences having conserved amino acids common among a number of sequences and variable amino acids that vary within a given amino acid sequences. The CDR consensus sequences provided include CDRs corresponding to each of CDRH1, CDRH2, CDRH3, CDRL1, CDRL2 and CDRL3.

Consensus sequences were determined using standard analyses of the CDRs corresponding to the $V_H$ and $V_L$ of the disclosed antigen binding proteins shown in Tables 3A and 3B, some of which specifically bind to a complex comprising β-Klotho and at least one of (i) FGFR1c, (ii) FGFR2c and (iii) FGFR3c. The consensus sequences can be determined by keeping the CDRs contiguous within the same sequence corresponding to a $V_H$ or $V_L$.

```
                Light Chain CDR3
                       Group 1

QQFGSSLT (SEQ ID NO: 1439)
                       Group 2

QQS  Y   S   T   S    LT (SEQ ID NO: 1440)
   QQS  Y   S   S   P    LT (SEQ ID NO: 1441)
   QQS  F   S   T   P    LT (SEQ ID NO: 1442)
   QQS  X1  S   X2  X3   LT (SEQ ID NO: 1443)
wherein X1 is Y or F; X2 is T or S; and X3 is P
or S.
                       Group 3

LQ   R   N   SYP L    T (SEQ ID NO: 1444)
   LQ   H   N   SYP R    T (SEQ ID NO: 1445)
   LQ   H   S   SYP L    T (SEQ ID NO: 1446)
   LQ   X4  X5  SYP X6   T (SEQ ID NO: 1447)
wherein X4 is H or R; X5 is N or S; and X6 is L
or R.
                       Group 4

MQR  I       EFP L    T (SEQ ID NO: 1448)
   MQR  I       EFP I    T (SEQ ID NO: 1449)
   MQR  L       EFP I    T (SEQ ID NO: 1450)
   MQR  X7      EFP X8   T (SEQ ID NO: 1451)
wherein X7 is I or L; and X8 us I or L.
                       Group 5

Q    V   WDS N   P    VV (SEQ ID NO: 1452)
   Q    L   WDS S   T    VV (SEQ ID NO: 1453)
   Q    V   WDS S   S    VV (SEQ ID NO: 1454)
   Q    V   WDS S   P    VV (SEQ ID NO: 1455)
   Q    V   WDS S   T    VV (SEQ ID NO: 1456)
   Q    X9  WDS X10 X11  VV (SEQ ID NO: 1457)
wherein X9 is V or L; X10 is S or N; and
X11 is T, P or S.
```

Light Chain CDR3

Group 6

| | | | | |
|---|---|---|---|---|
| QQYN | N | WP | L | T (SEQ ID NO: 1458) |
| QQYN | N | WP | W | T (SEQ ID NO: 1459) |
| QQYN | T | WP | W | T (SEQ ID NO: 1460) |
| QQYN | $X_{12}$ | WP | $X_{13}$ | T (SEQ ID NO: 1461) | wherein $X_{12}$ is N or T; and $X_{13}$ is W or L.

Group 7

| | | | | |
|---|---|---|---|---|
| QVWDSS | S | D | H | V | V (SEQ ID NO: 1462) |
| QVWDSS | S | D | V | V (SEQ ID NO: 1463) |
| QVWDSS | C | D | G | V (SEQ ID NO: 1464) |
| QVWDSS | S | D | G | V (SEQ ID NO: 1465) |
| QVWDSS | $X_{14}$ | D | $X_{15}$ | V | $X_{16}$ (SEQ ID NO: 1466) | wherein $X_{14}$ is S or C; $X_{15}$ is H, V or G; and $X_{16}$ is V or absent.

Group 8

| | | | |
|---|---|---|---|
| QQSS | S | IPWT | (SEQ ID NO: 1467) |
| QQSS | T | IPWT | (SEQ ID NO: 1468) |
| QQSS | $X_{17}$ | IPWT | (SEQ ID NO: 1469) | wherein $X_{17}$ is S or T.

Group 9

QQTNSFPPWT (SEQ ID NO: 1470)

Group 10

| | | | |
|---|---|---|---|
| GTWDSSLS | A | V | V (SEQ ID NO: 1471) |
| GTWDSSLS | V | V | V (SEQ ID NO: 1472) |
| GTWDSSLS | A | M | V (SEQ ID NO: 1473) |
| GTWDSSLS | $X_{18}$ | $X_{19}$ | V (SEQ ID NO: 1474) | wherein $X_{18}$ is A or V; and $X_{19}$ is V or M.

Group 11

| | | |
|---|---|---|
| QQYDNLP | L | T (SEQ ID NO: 1475) |
| QQYDNLP | F | T (SEQ ID NO: 1476) |
| QQYDNLP | $X_{20}$ | T (SEQ ID NO: 1477) | wherein $X_{20}$ is L or F.

Group 12

| | | | |
|---|---|---|---|
| QQYGSS | P | | PWT (SEQ ID NO: 1478) |
| QQYGSS | | | PWT (SEQ ID NO: 1479) |
| QQYGSS | $X_{21}$ | | PWT (SEQ ID NO: 1480) | wherein $X_{21}$ is P or absent.

Group 13

| | | | | |
|---|---|---|---|---|
| QQYG | R | S | L | FT (SEQ ID NO: 1481) |
| QQYG | T | S | P | FT (SEQ ID NO: 1482) |
| QQYG | $X_{22}$ | S | $X_{23}$ | FT (SEQ ID NO: 1483) | wherein $X_{22}$ is R or T; and $X_{23}$ is L or P.

Group 14

| | | | |
|---|---|---|---|
| QQYGSS | | R | S (SEQ ID NO: 1484) |
| QQYGSS | P | R | S (SEQ ID NO: 1485) |
| QQYGSS | | R | T (SEQ ID NO: 1486) |
| QQYGSS | | C | S (SEQ ID NO: 1487) |
| QQYGSS | $X_{24}$ | $X_{25}$ | $X_{26}$ (SEQ ID NO: 1488) | wherein $X_{24}$ is P or absent; $X_{25}$ is R or C and $X_{26}$ is S or T.

Group 15

| | | | | |
|---|---|---|---|---|
| QADWSS | T | T | W | V (SEQ ID NO: 1489) |
| QADWSS | | T | A | V (SEQ ID NO: 1490) |
| QADWSS | | T | W | V (SEQ ID NO: 1491) |
| QAWDSS | $X_{27}$ | T | $X_{28}$ | V (SEQ ID NO: 1492) | wherein $X_{27}$ is T or absent; and $X_{28}$ is W or A.

Group 16

| | | | |
|---|---|---|---|
| QADWS | G | TV | V (SEQ ID NO: 1493) |
| QADWS | T | TV | V (SEQ ID NO: 1494) |
| QAWDS | A | TV | I (SEQ ID NO: 1495) |
| QAWDS | $X_{29}$ | TV | $X_{30}$ (SEQ ID NO: 1496) | wherein $X_{29}$ is G, T, A or absent; and $X_{30}$ is V or I.

Group 17

| | | | | |
|---|---|---|---|---|
| QQ | S | YSA | | FT (SEQ ID NO: 1497) |
| QQ | T | YSA | P | FT (SEQ ID NO: 1498) |
| QQ | $X_{31}$ | YSA | $X_{32}$ | FT (SEQ ID NO: 1499) | wherein $X_{31}$ is S or T; and $X_{32}$ is T or P.

Group 18

| | | |
|---|---|---|
| QQYN | I | YPRT (SEQ ID NO: 1500) |
| QQYN | T | YPRT (SEQ ID NO: 1501) |
| QQYN | $X_{33}$ | YPRT (SEQ ID NO: 1502) | wherein $X_{33}$ is I or T.

Group 19

| | | | |
|---|---|---|---|
| HQ | S | S | DLPLT (SEQ ID NO: 1503) |
| HQ | Y | D | DLPLT (SEQ ID NO: 1504) |
| HQ | $X_{34}$ | $X_{35}$ | DLPLT (SEQ ID NO: 1505) | wherein $X_{34}$ is S or Y; and $X_{35}$ is S or D.

Group 20

| | | | |
|---|---|---|---|
| MQALQT | P | F | T (SEQ ID NO: 1506) |
| MQALQT | L | I | T (SEQ ID NO: 1507) |
| MQALQT | $X_{36}$ | $X_{37}$ | T (SEQ ID NO: 1508) | wherein $X_{36}$ is P or L; and $X_{37}$ is F or I.

Group 21

QQFGRSFT (SEQ ID NO: 1509)

Group 22

| | | |
|---|---|---|
| YSTDSS | V | NHVV (SEQ ID NO: 1510) |
| YSTDSS | G | NHVV (SEQ ID NO: 1511) |
| YSTDSS | $X_{38}$ | NHVV (SEQ ID NO: 1512) | wherein $X_{38}$ is V or G.

Light Chain CDR2

Group 1

| | | | | |
|---|---|---|---|---|
| A | ASSL | Q | | S (SEQ ID NO: 1513) |
| S | ASSL | Q | | S (SEQ ID NO: 1514) |
| A | ASSL | Q | | F (SEQ ID NO: 1515) |
| A | ASSL | K | | S (SEQ ID NO: 1516) |
| $X_{39}$ | ASSL | $X_{40}$ | | $X_{41}$ (SEQ ID NO: 1517) | wherein $X_{39}$ is A or S; $X_{40}$ is Q or K; and $X_{41}$ is S or F.

Group 2

| | | | | | |
|---|---|---|---|---|---|
| G | A | S | S | R | A | T (SEQ ID NO: 1518) |
| G | A | S | S | R | D | T (SEQ ID NO: 1519) |
| G | T | S | T | R | A | T (SEQ ID NO: 1520) |
| G | A | S | T | R | A | T (SEQ ID NO: 1521) |
| G | A | S | A | R | A | T (SEQ ID NO: 1522) |
| G | A | S | R | R | A | T (SEQ ID NO: 1523) |
| G | A | S | N | R | A | T (SEQ ID NO: 1524) |
| G | $X_{42}$ | S | $X_{43}$ | R | $X_{44}$ | T (SEQ ID NO: 1525) | wherein $X_{42}$ is A or T; $X_{43}$ is S, T, A, R or N; and $X_{44}$ is A or D.

Group 3

| | |
|---|---|
| GAFSRA | S (SEQ ID NO: 1526) |
| GAFSRA | T (SEQ ID NO: 1527) |
| GAFSRA | $X_{45}$ (SEQ ID NO: 1528) | wherein $X_{45}$ is S or T.

Group 4

| | | | |
|---|---|---|---|
| Q | D | T | KRPS (SEQ ID NO: 1529) |
| R | D | S | KRPS (SEQ ID NO: 1530) |
| E | D | S | KRPS (SEQ ID NO: 1531) |
| Q | D | S | KRPS (SEQ ID NO: 1532) |
| $X_{46}$ | D | $X_{47}$ | KRPS (SEQ ID NO: 1533) | wherein $X_{46}$ is Q, R or E; and $X_{47}$ is T or S.

Light Chain CDR2

Group 5

```
TLS    Y     RAS  (SEQ ID NO: 1534)
TLS    F     RAS  (SEQ ID NO: 1535)
TLS    X48   RAS  (SEQ ID NO: 1536)
```
wherein $X_{48}$ is Y or F.

Group 6

```
AASNLQ    R  (SEQ ID NO: 1537)
AASNLQ    S  (SEQ ID NO: 1538)
AASNLQ    X49  (SEQ ID NO: 1539)
```
wherein $X_{49}$ is R or S.

Group 7

```
G    A     SNRA   I  (SEQ ID NO: 1540)
G    S     SNRA   I  (SEQ ID NO: 1541)
G    S     SNRA   T  (SEQ ID NO: 1542)
G    X50   SNRA   X51  (SEQ ID NO: 1543)
```
wherein $X_{50}$ is A or S; and $X_{51}$ is I or T.

Group 8

```
D    A    S    S    LQS  (SEQ ID NO: 1544)
D    A    S    T    LQS  (SEQ ID NO: 1545)
G    A    S    S    LQS  (SEQ ID NO: 1546)
G    A    S    N    LQS  (SEQ ID NO: 1547)
X52  A    S    X53  LQS  (SEQ ID NO: 1548)
```
wherein $X_{52}$ is D or G; and $X_{53}$ is S, T or N.

Group 9

```
DN    N     KRPS  (SEQ ID NO: 1549)
DN    D     KRPS  (SEQ ID NO: 1550)
DN    X53   KRPS  (SEQ ID NO: 1551)
```
wherein $X_{53}$ is N or D.

Group 10

```
D    A     SNLET  (SEQ ID NO: 1552)
D    V     SNLET  (SEQ ID NO: 1553)
D    X54   SNLET  (SEQ ID NO: 1554)
```
wherein $X_{54}$ is A or V.

Group 11

```
L    G     SNRAS  (SEQ ID NO: 1555)
L    D     SNRAS  (SEQ ID NO: 1556)
L    X55   SNRAS  (SEQ ID NO: 1557)
```
wherein $X_{55}$ is G or D.

Group 12

```
Q    D     N    K    RPS  (SEQ ID NO: 1558)
Q    N     N    K    RPS  (SEQ ID NO: 1559)
Q    D     N    E    RPS  (SEQ ID NO: 1560)
Q    X56   N    X57  RPS  (SEQ ID NO: 1561)
```
wherein $X_{56}$ is D or N; and $X_{57}$ is K or E.

Group 13

```
RDRNRPS  (SEQ ID NO: 1562)
```

Group 14

```
S     DSNRPS  (SEQ ID NO: 1563)
C     DSNRPS  (SEQ ID NO: 1564)
X58   DSNRPS  (SEQ ID NO: 1565)
```
wherein $X_{58}$ is S or C.

Group 15

```
DDSDRPS  (SEQ ID NO: 1566)
```

Group 16

```
A    V     SSLQS  (SEQ ID NO: 1567)
A    S     SSLQS  (SEQ ID NO: 1568)
A    X59   SSLQS  (SEQ ID NO: 1569)
```
wherein $X_{59}$ is S or V.

Group 17

```
T    A     SSLQS  (SEQ ID NO: 1570)
T    T     SSLQS  (SEQ ID NO: 1571)
T    X60   SSLQS  (SEQ ID NO: 1572)
```
wherein $X_{60}$ is A or T.

Group 18

```
K    V     SNWDS  (SEQ ID NO: 1573)
K    G     SNWDS  (SEQ ID NO: 1574)
K    X61   SNWDS  (SEQ ID NO: 1575)
```
wherein $X_{61}$ is V or G.

Light Chain CDR1

Group 1

```
RASQ   S    V    S    D    I    L    A  (SEQ ID NO: 1576)
RASP   5    V    S    S    Y    L    A  (SEQ ID NO: 1577)
RASQ   S    F    S    S    Y    L    A  (SEQ ID NO: 1578)
RASQ   S    V    S    R    S    H    L    A  (SEQ ID NO: 1579)
RASQ   S    V    S    R    D    Y    L    A  (SEQ ID NO: 1580)
RASQ   S    V    S    R    N    Y    L    A  (SEQ ID NO: 1581)
RASQ   S    V    S    S    M    Y    L    A  (SEQ ID NO: 1582)
RASQ   S    V    S    S    Q    L    A  (SEQ ID NO: 1583)
RASQ   S    I    S    S    N    L    A  (SEQ ID NO: 1584)
RASQ   S    V    S    S    N    L    A  (SEQ ID NO: 1585)
RASQ   S    V    S    S    N    V    A  (SEQ ID NO: 1586)
RASQ   S    V    N    S    N    L    A  (SEQ ID NO: 1587)
RASQ   S    V    R    S    S    S    L    A  (SEQ ID NO: 1588)
RASQ   S    V    S    N    S    S    L    A  (SEQ ID NO: 1589)
RASQ   S    V    R    N    S    S    L    A  (SEQ ID NO: 1590)
RAS X62  S  X63  X64  X65  X66  X67  X68  A  (SEQ ID NO: 1591)
```
wherein $X_{62}$ is P or Q; $X_{63}$ is V, I or F; $X_{64}$ is S, R or absent; $X_{65}$ is S, R or N; $X_{66}$ is D, S, N or M; $X_{67}$ is I, Y, H, Q, N or S; and $X_{68}$ is L or V.

Group 2

```
R    A    SQ   I    I    S    R    YLN  (SEQ ID NO: 1592)
R    T    SQ   S    I    S    S    YLN  (SEQ ID NO: 1593)
R    A    SQ   S    I    S    N    YLN  (SEQ ID NO: 1594)
R    T    SQ   S    I    S    S    YLN  (SEQ ID NO: 1595)
R    A    SQ   T    I    S    I    YLN  (SEQ ID NO: 1596)
R    A    SQ   R    I    S    S    YLN  (SEQ ID NO: 1597)
R    A    SQ   S    I    S    S    YLN  (SEQ ID NO: 1598)
R    A    SQ   N    I    R    T    YLN  (SEQ ID NO: 1599)
R    A    SQ   N    I    R    S    YLN  (SEQ ID NO: 1600)
R    A    SQ   N    I    N    N    YLN  (SEQ ID NO: 1601)
R    X69  SQ   X70  I    X71  X72  YLN  (SEQ ID NO: 1602)
```
wherein $X_{69}$ is A or T; $X_{70}$ is I, S, T or N; $X_{71}$ is R, S or N; and $X_{72}$ is R, S, N, or I.

Group 3

```
GGN   N    IGS   Y    N    V    H  (SEQ ID NO: 1603)
GGN   N    IGS   I    N    V    H  (SEQ ID NO: 1604)
GGN   N    IGS   K    S    V    Q  (SEQ ID NO: 1605)
GGN   D    IGS   K    S    V    H  (SEQ ID NO: 1606)
GGN   N    IGS   K    S    V    H  (SEQ ID NO: 1607)
GGN   N    IGS   K    T    V    H  (SEQ ID NO: 1608)
GGN   N    IGS   K    A    V    H  (SEQ ID NO: 1609)
GGN   N    IGS   K    N    V    H  (SEQ ID NO: 1610)
GGN   D    IGS   K    N    V    H  (SEQ ID NO: 1611)
GGN   X73  IGS   X74  X75  V    X76  (SEQ ID NO: 1612)
```
wherein $X_{73}$ is N, or D; $X_{74}$ is Y, I or K; $X_{75}$ is N, S, T or A; and $X_{76}$ is H or Q.

Group 4

```
RASQ   D     IRNDL   G  (SEQ ID NO: 1613)
RASQ   D     IRNDL   A  (SEQ ID NO: 1614)
RASQ   G     IRNDL   G  (SEQ ID NO: 1615)
RASQ   X77   IRNDL   X78  (SEQ ID NO: 1616)
```
wherein $X_{77}$ is D or G; and $X_{78}$ is G or A.

Group 5

```
RSSQSL   L    N    S    D    A    G    T    TYLD  (SEQ ID NO: 1617)
RSSQSL   F    D    N    D    D    G    D    TYLD  (SEQ ID NO: 1618)
RSSQSL   L    N    S    D    D    G    N    TYLD  (SEQ ID NO: 1619)
```

-continued

Light Chain CDR1

| | | | | | | | |
|---|---|---|---|---|---|---|---|
| RSSQSL | L | D | S | D D | G | D | TYLD (SEQ ID NO: 1620) |
| RSSQSL | L | D | S | D D | G | N | TYLD (SEQ ID NO: 1621) |
| RSSQSL | X$_{79}$ | X$_{80}$ | X$_{81}$ | D X$_{82}$ | G | X$_{83}$ | TYLD (SEQ ID NO: 1622) | wherein X$_{79}$ is L or F; X$_{80}$ is N or D; X$_{81}$ is S or N; X$_{82}$ is A or D; and X$_{83}$ is T, D or N.

Group 6

| | | | | | | |
|---|---|---|---|---|---|---|
| SG | N | K | LGDKY | V | C | (SEQ ID NO: 1623) |
| SG | D | K | LGDKY | V | C | (SEQ ID NO: 1624) |
| SG | D | K | LGDKY | A | C | (SEQ ID NO: 1625) |
| SG | D | E | LGDKY | A | C | (SEQ ID NO: 1626) |
| SG | D | N | LGDKY | A | F | (SEQ ID NO: 1627) |
| SG | D | N | LGDKY | A | C | (SEQ ID NO: 1628) |
| SG | X$_{84}$ | X$_{85}$ | LGDKY | X$_{86}$ | X$_{87}$ | (SEQ ID NO: 1629) | wherein X$_{84}$ is N or D; X$_{85}$ is K, E or N; X$_{86}$ is V or A; and X$_{87}$ is C or F.

Group 7

| | | | | | | | |
|---|---|---|---|---|---|---|---|
| QASQ | G | I | S | N | Y | LN | (SEQ ID NO: 1630) |
| QASQ | D | I | K | K | F | LN | (SEQ ID NO: 1631) |
| QASQ | D | I | N | I | Y | LN | (SEQ ID NO: 1632) |
| QASQ | D | I | S | I | Y | LN | (SEQ ID NO: 1633) |
| QASQ | D | I | T | K | Y | LN | (SEQ ID NO: 1634) |
| QASQ | X$_{88}$ | I | X$_{89}$ | X$_{90}$ | X$_{91}$ | LN | (SEQ ID NO: 1635) | wherein X$_{88}$ is G or D; X$_{89}$ is S, K N or T; X$_{90}$ is N, K or I; and X$_{91}$ is Y or F.

Group 8

| | | | | | | |
|---|---|---|---|---|---|---|
| RASQ | D | I | D | S | WL | V (SEQ ID NO: 1636) |
| RASQ | G | I | S | R | WL | A (SEQ ID NO: 1637) |
| RASQ | D | I | S | S | WL | A (SEQ ID NO: 1638) |
| RASQ | G | I | S | S | WL | A (SEQ ID NO: 1639) |
| RASQ | X$_{92}$ | I | X$_{93}$ | X$_{94}$ | WL | X$_{95}$ (SEQ ID NO: 1640) | wherein X$_{92}$ is D or G; X$_{93}$ is D or S; X$_{94}$ is R or S; and X$_{95}$ is V or A.

Group 9

| | | | | |
|---|---|---|---|---|
| SGSSSNIG | N | NYV | A | (SEQ ID NO: 1641) |
| SGSSSNIG | I | NYV | S | (SEQ ID NO: 1642) |
| SGSSSNIG | D | NYV | S | (SEQ ID NO: 1643) |
| SGSSSNIG | N | NYV | S | (SEQ ID NO: 1644) |
| SGSSSNIG | X$_{96}$ | NYV | X$_{97}$ | (SEQ ID NO: 1645) | wherein X$_{96}$ is N, I or D; and X$_{97}$ is A or S.

Light Chain CDR1

Group 10

| | | | |
|---|---|---|---|
| RAS | Q | DISNYLA | (SEQ ID NO: 1646) |
| RAS | H | DISNYLA | (SEQ ID NO: 1647) |
| RAS | X$_{98}$ | DISNYLA | (SEQ ID NO: 1648) | wherein X$_{98}$ is Q or H.

Group 11

| | | | | | | |
|---|---|---|---|---|---|---|
| RASQ | R | V | P | SSY | I | V (SEQ ID NO: 1649) |
| RASQ | R | V | P | SSY | L | V (SEQ ID NO: 1650) |
| RASQ | S | V | A | SSY | L | V (SEQ ID NO: 1651) |
| RASQ | X$_{99}$ | V | X$_{100}$ | SSY | X$_{101}$ | V (SEQ ID NO: 1652) | wherein X$_{99}$ is R or S; X$_{100}$ is P or A; and X$_{101}$ is I or L.

Group 12

| | | | | |
|---|---|---|---|---|
| RSSQSL | L | HSNG | Y | NYLD (SEQ ID NO: 1653) |
| RSSQSL | L | HSNG | F | NYLD (SEQ ID NO: 1654) |
| RSSQSL | Q | HSNG | Y | NYLD (SEQ ID NO: 1655) |
| RSSQSL | X$_{102}$ | HSNG | X$_{103}$ | NYLD (SEQ ID NO: 1656) | wherein X$_{102}$ is L or Q; and X$_{103}$ is Y or F.

Group 13

| | | | | |
|---|---|---|---|---|
| RASQT | V | RN | N | YLA (SEQ ID NO: 1657) |
| RASQT | I | RN | S | YLA (SEQ ID NO: 1658) |
| RASQT | X$_{104}$ | RN | X$_{105}$ | YLA (SEQ ID NO: 1659) | wherein X$_{104}$ is V or I; and X$_{105}$ is N or S.

Group 14

| | | | | |
|---|---|---|---|---|
| RSS | Q | R | LVYSDGNTYLN | (SEQ ID NO: 1660) |
| RSS | P | S | LVYSDGNTYLN | (SEQ ID NO: 1661) |
| RSS | X$_{106}$ | X$_{107}$ | LVYSDGNTYLN | (SEQ ID NO: 1662) | wherein X$_{106}$ is Q or P; and X$_{107}$ is R or S.

Group 15

| | | | | |
|---|---|---|---|---|
| SGDA | L | PKKYA | Y | (SEQ ID NO: 1663) |
| SGDA | V | PKKYA | N | (SEQ ID NO: 1664) |
| SGDA | X$_{108}$ | PKKYA | X$_{109}$ | (SEQ ID NO: 1665) | wherein X$_{108}$ is L or V; and X$_{109}$ is Y or N.

Heavy Chain CDR3

Group 1

| | | | | |
|---|---|---|---|---|
| MT | T | PYWYF | D | L (SEQ ID NO: 1666) |
| MT | S | PYWYF | D | L (SEQ ID NO: 1667) |
| MT | T | PYWYF | G | L (SEQ ID NO: 1668) |
| MT | X$_{110}$ | PYWYF | X$_{111}$ | L (SEQ ID NO: 1669) | wherein X$_{110}$ is T or S; and X$_{111}$ is D or G.

Group 2

| | | | | | | | | | |
|---|---|---|---|---|---|---|---|---|---|
| D R | Y | Y | DFW S | GYP Y | F | R | YYG L | DV (SEQ ID NO: 1670) |
| D Q | Y | F | DFW S | GYP F | F | Y | YYG M | DV (SEQ ID NO: 1671) |
| D Q | D | Y | DFW S | GYP Y | F | Y | YYG M | DV (SEQ ID NO: 1672) |
| D Q | N | Y | DFW N | GYP Y | Y | F | YYG M | DV (SEQ ID NO: 1673) |
| D Q | Y | Y | DFW S | GYP Y | Y | H | YYG M | DV (SEQ ID NO: 1674) |
| D X$_{112}$ | X$_{113}$ | X$_{114}$ | DFW X$_{115}$ | GYP X$_{116}$ | X$_{117}$ | X$_{118}$ | YYG X$_{119}$ | DV (SEQ ID NO: 1675) | wherein X$_{112}$ is R or Q; X$_{113}$ is Y, D or N; X$_{114}$ is Y or F; X$_{115}$ is S or N; X$_{116}$ is Y or F; X$_{117}$ is F or Y; X$_{118}$ is R, Y, F or H; and X$_{119}$ is L or M.

Group 3

VTGTDAFDF (SEQ ID NO: 1676)

Group 4

TVTKEDYYYGMDV (SEQ ID NO: 1677)

Group 5

DSSGSYYVEDYFDY (SEQ ID NO: 1678)

Heavy Chain CDR3

Group 6

| | | | | | | |
|---|---|---|---|---|---|---|
| D | W | S | IAVAG | T | | FDY (SEQ ID NO: 1679) |
| D | L | R | IAVAG | S | | FDY (SEQ ID NO: 1680) |
| D | $X_{119}$ | $X_{120}$ | IAVAG | $X_{121}$ | | FDY (SEQ ID NO: 1681) | wherein $X_{119}$ is W or L; $X_{120}$ is S or R; and $X_{121}$ is T or S.

Group 7

EYYYGSGSYYP (SEQ ID NO: 1682)

Group 8

ELGDYPFFDY (SEQ ID NO: 1683)

Group 9

EYVAEAGFDY (SEQ ID NO: 1684)

Group 10

VAAVYWYFDL (SEQ ID NO: 1685)

Group 11

YNWNYGAFDF (SEQ ID NO: 1686)

Group 12

| | | | |
|---|---|---|---|
| RASRGYR | F | GLAFAI | (SEQ ID NO: 1687) |
| RASRGYR | Y | GLAFAI | (SEQ ID NO: 1688) |
| RASRGYR | $X_{122}$ | GLAFAI | (SEQ ID NO: 1689) | wherein $X_{122}$ is F or Y.

Group 13

DGITMVRGVTHYYGMDV (SEQ ID NO: 1690)

Group 14

| | | | |
|---|---|---|---|
| DH | S | SGWYYYGMDV | (SEQ ID NO: 1691) |
| DH | T | SCWYYYGMDV | (SEQ ID NO: 1692) |
| DH | $X_{123}$ | SCWYYYGMDV | (SEQ ID NO: 1693) | wherein $X_{123}$ is S or T.

Group 15

| | | | | | | |
|---|---|---|---|---|---|---|
| Y | S | T | WDYYYG | V | DV | (SEQ ID NO: 1694) |
| Y | R | D | WDYYYG | M | DV | (SEQ ID NO: 1695) |
| Y | $X_{124}$ | $X_{125}$ | WDYYYG | $X_{126}$ | DV | (SEQ ID NO: 1696) | wherein $X_{124}$ is S or R; $X_{125}$ is T or D; and $X_{126}$ is V or M.

Group 16

| | | | | | | | | |
|---|---|---|---|---|---|---|---|---|
| VLHY | S | DS | R | GYSYY | S | D | F | (SEQ ID NO: 1697) |
| VLHY | Y | DS | S | GYSYY | F | D | Y | (SEQ ID NO: 1698) |
| VLHY | $X_{127}$ | DS | $X_{128}$ | GYSYY | $X_{129}$ | D | $X_{130}$ | (SEQ ID NO: 1699) | wherein $X_{127}$ is S or Y; $X_{128}$ is R or S; $X_{129}$ is S or F; and $X_{130}$ is F or Y.

Heavy Chain CDR2

Group 1

| | | | | | | | | | | |
|---|---|---|---|---|---|---|---|---|---|---|
| N | I | Y | Y | S | G T | T | Y | F | NPSLKS | (SEQ ID NO: 1700) |
| F | I | Y | Y | S | G G | T | N | Y | NPSLKS | (SEQ ID NO: 1701) |
| Y | I | Y | Y | S | G G | T | H | Y | NPSLKS | (SEQ ID NO: 1702) |
| Y | I | Y | H | S | G S | A | Y | Y | NPSLKS | (SEQ ID NO: 1703) |
| Y | I | Y | D | S | G S | T | Y | Y | NPSLKS | (SEQ ID NO: 1704) |
| S | I | Y | Y | S | G T | T | Y | Y | NPSLKS | (SEQ ID NO: 1705) |
| M | I | Y | Y | S | G T | T | Y | Y | NPSLKS | (SEQ ID NO: 1706) |
| Y | I | Y | Y | S | G T | T | Y | Y | NPSLKS | (SEQ ID NO: 1707) |
| Y | I | Y | Y | S | G S | A | Y | Y | NPSLKS | (SEQ ID NO: 1708) |
| Y | I | F | Y | S | G S | T | Y | Y | NPSLKS | (SEQ ID NO: 1709) |
| Y | L | Y | Y | S | G S | T | Y | Y | NPSLKS | (SEQ ID NO: 1710) |
| Y | I | Y | Y | S | G S | T | Y | Y | NPSLKS | (SEQ ID NO: 1711) |
| Y | I | Y | Y | T | G S | T | Y | Y | NPSLKS | (SEQ ID NO: 1712) |
| Y | I | Y | Y | T | G S | T | N | Y | NPSLKS | (SEQ ID NO: 1713) |

| Heavy Chain CDR2 |
|---|
| Y   I   Y   Y   S   G N   T   N   Y   NPSLKS (SEQ ID NO: 1714) |
| Y   I   Y   Y   S   G S   T   N   Y   NPSLKS (SEQ ID NO: 1715) |
| X$_{131}$   X$_{132}$   X$_{133}$   X$_{134}$   X$_{135}$   G X$_{136}$   X$_{137}$   X$_{138}$   X$_{139}$   NPSLKS (SEQ ID NO: 1716) |
| wherein X$_{131}$ is N, F, Y, S or M; X$_{132}$ is I or L; X$_{133}$ is Y or F; X$_{134}$ is Y, H or D; X$_{135}$ is S or T; X$_{136}$ is T, G, S or T; X$_{137}$ is T or A; X$_{138}$ is Y, N or H; and X$_{139}$ is F or Y. |
| Group 2 |
| L   I   W   Y   DG   D   N   K   Y   Y   ADSVKG (SEQ ID NO: 1717) |
| G   I   S   Y   DG   S   N   K   N   Y   ADSVKG (SEQ ID NO: 1718) |
| I   I   W   Y   DG   S   N   K   N   Y   ADSVKG (SEQ ID NO: 1719) |
| L   I   W   Y   DG   S   N   K   N   Y   ADSVKG (SEQ ID NO: 1720) |
| L   I   W   Y   DG   S   N   K   D   Y   ADSVKG (SEQ ID NO: 1721) |
| V   I   W   Y   DG   S   N   K   D   Y   ADSVKG (SEQ ID NO: 1722) |
| L   I   S   Y   DG   S   N   K   Y   Y   ADSVKG (SEQ ID NO: 1723) |
| V   I   S   Y   DG   S   N   K   H   Y   ADSVKG (SEQ ID NO: 1724) |
| V   I   S   Y   DG   S   N   K   Y   Y   ADSVKG (SEQ ID NO: 1725) |
| V   I   W   D   DG   S   N   K   Y   Y   ADSVKG (SEQ ID NO: 1726) |
| V   I   W   D   DG   S   N   N   Y   Y   ADSVKG (SEQ ID NO: 1727) |
| I   I   W   Y   DG   S   N   K   Y   H   ADSVKG (SEQ ID NO: 1728) |
| V   I   W   Y   DG   S   N   K   Y   Y   ADSVKG (SEQ ID NO: 1729) |
| V   I   W   N   DG   N   N   K   Y   Y   ADSVKG (SEQ ID NO: 1730) |
| V   I   W   N   DG   S   N   K   N   Y   ADSVKG (SEQ ID NO: 1731) |
| X$_{140}$   I   X$_{141}$   X$_{142}$   DG   X$_{143}$   N   X$_{144}$   X$_{145}$   X$_{146}$   ADSVKG (SEQ ID NO: 1732) |
| wherein X$_{140}$ is L, G, I or V; X$_{141}$ is W or S; X$_{142}$ is Y, D or N; X$_{143}$ is S or D; X$_{144}$ is K or N; X$_{145}$ is Y, N, D, or H; and X$_{146}$ is Y or H. |
| Group 3 |
| W   I   NP   P   SG   A   T   N   YAQKF   R   G (SEQ ID NO: 1733) |
| W   I   NP   N   SG   G   T   N   YAQKF   R   G (SEQ ID NO: 1734) |
| W   I   NP   N   SG   A   T   N   YAQKF   H   G (SEQ ID NO: 1735) |
| W   I   NP   S   SG   D   T   K   YAQKF   Q   G (SEQ ID NO: 1736) |
| W   M   NP   N   SG   A   T   K   YAQKF   Q   G (SEQ ID NO: 1737) |
| W   I   NP   N   SG   A   T   K   YAQKF   Q   G (SEQ ID NO: 1738) |
| W   I   NP   D   SG   G   T   N   YAQKF   Q   G (SEQ ID NO: 1739) |
| W   I   NP   N   SG   G   T   D   YAQKF   Q   G (SEQ ID NO: 1740) |
| W   X$_{147}$   NP   X$_{148}$   SG   X$_{149}$   T   X$_{150}$   YAQKF   X$_{151}$   G (SEQ ID NO: 1741) |
| wherein X$_{147}$ is I or M; X$_{148}$ is P, N, S or D; X$_{149}$ is A, G or D; X$_{150}$ is N, K, or D; X$_{151}$ is R, H or Q. |
| Group 4 |
| EINHS   E   N   TNYNPSLKS (SEQ ID NO: 1742) |
| EINHS   G   T   TNYNPSLKS (SEQ ID NO: 1743) |
| EINHS   X$_{152}$   X$_{153}$   TNYNPSLKS (SEQ ID NO: 1744) |
| wherein X$_{152}$ is E or G; and X$_{153}$ is N or T. |
| Group 5 |
| IIYPGDS   D   TRYSPSFQG (SEQ ID NO: 1745) |
| IIYPGDS   E   TRYSPSFQG (SEQ ID NO: 1746) |
| IIYPGDS   X$_{154}$   TRYSPSFQG (SEQ ID NO: 1747) |
| wherein X$_{154}$ is D or E. |
| Group 6 |
| SISSSS   T   Y   I   YY   A   DS   V   KG (SEQ ID NO: 1748) |
| SISSSS   T   Y   I   YY   A   DS   L   KG (SEQ ID NO: 1749) |
| SISSSS   S   Y   E   YY   V   DS   V   KG (SEQ ID NO: 1750) |
| SISSSS   X$_{155}$   Y   X$_{156}$   YY   X$_{157}$   DS   X$_{158}$   KG (SEQ ID NO: 1751) |
| wherein X$_{155}$ is T or S; X$_{156}$ is I or E; X$_{157}$ is A or V; and X$_{158}$ is V or L. |
| Group 7 |
| RI   K   S   KTDGGTT   D   YAAPVKG (SEQ ID NO: 1752) |
| RI   K   S   KTDGGTT   E   YAAPVKG (SEQ ID NO: 1753) |
| RI   I   G   KTDGGTT   D   YAAPVKG (SEQ ID NO: 1754) |
| RI   X$_{159}$   X$_{160}$   KTDGGTT   X$_{161}$   YAAPVKG (SEQ ID NO: 1755) |
| wherein X$_{159}$ is K or I; X$_{160}$ is S or G; and X$_{161}$ is D or E. |
| Group 8 |
| GISGSSAGTYYADSVGK (SEQ ID NO: 1756) |
| Group 9 |
| VIS   D   SGG   S   TYYADSVKG (SEQ ID NO: 1757) |
| VIS   G   SGG   D   TYYADSVKG (SEQ ID NO: 1758) |
| VIS   X$_{162}$   SGG   X$_{163}$   TYYADSVKG (SEQ ID NO: 1759) |
| wherein X$_{162}$ is D or G; and X$_{163}$ is S or D. |

-continued

| Heavy Chain CDR2 |
|---|

Group 10

RTYYRSKWYNDYAVSVKS (SEQ ID NO: 1760)

Group 11

| | | | | |
|---|---|---|---|---|
| RIY | I | SGSTNYNPSL | E | N (SEQ ID NO: 1761) |
| RIY | T | SGSTNYNPSL | K | S (SEQ ID NO: 1762) |
| RIY | $X_{164}$ | SGSTNYNPSL | $X_{165}$ | $X_{166}$ (SEQ ID NO: 1763) | wherein $X_{164}$ is I or T; $X_{165}$ is E or K; and $X_{166}$ is N or S.

Group 12

| | | | | |
|---|---|---|---|---|
| WMNPYSGSTG | Y | AQ | N | FQ | G (SEQ ID NO: 1764) |
| WMNPYSGSTG | L | AQ | R | FQ | D (SEQ ID NO: 1765) |
| WMNPYSGSTG | $X_{167}$ | AQ | $X_{168}$ | FQ | $X_{169}$ (SEQ ID NO: 1766) | wherein $X_{167}$ is Y or L; $X_{168}$ is N or R; and $X_{169}$ is G or D.

| Heavy Chain CDR1 |
|---|

Group 1

| | | | | |
|---|---|---|---|---|
| SG | V | Y | YW | N (SEQ ID NO: 1767) |
| SG | V | Y | YW | S (SEQ ID NO: 1768) |
| SG | G | Y | YW | N (SEQ ID NO: 1769) |
| SG | G | Y | YW | S (SEQ ID NO: 1770) |
| SG | D | N | TW | S (SEQ ID NO: 1771) |
| SG | N | Y | TW | S (SEQ ID NO: 1772) |
| SG | D | Y | TW | T (SEQ ID NO: 1773) |
| SG | D | Y | TW | S (SEQ ID NO: 1774) |
| SG | $X_{170}$ | $X_{171}$ | TW | $X_{172}$ (SEQ ID NO: 1775) | wherein $X_{170}$ is V, G, N or D; $X_{171}$ is Y or N; and $X_{172}$ is N, S or T.

Group 2

| | | | |
|---|---|---|---|
| T | YYW | S (SEQ ID NO: 1776) |
| Y | YYW | S (SEQ ID NO: 1777) |
| S | YYW | S (SEQ ID NO: 1778) |
| G | YYW | S (SEQ ID NO: 1779) |
| G | YYW | T (SEQ ID NO: 1780) |
| $X_{173}$ | YYW | $X_{174}$ (SEQ ID NO: 1781) | wherein $X_{173}$ is T, S or G; and $X_{174}$ is S or T.

Group 3

| | | | |
|---|---|---|---|
| S | Y | GMH (SEQ ID NO: 1782) |
| S | F | GMH (SEQ ID NO: 1783) |
| T | Y | GMH (SEQ ID NO: 1784) |
| F | Y | GMH (SEQ ID NO: 1785) |
| $X_{175}$ | $X_{176}$ | GMH (SEQ ID NO: 1786) | wherein $X_{175}$ is S, T or F; and $X_{176}$ is Y or F.

Group 4

| | | | | |
|---|---|---|---|---|
| SY | A | M | S (SEQ ID NO: 1787) |
| SY | S | M | N (SEQ ID NO: 1788) |
| SY | S | M | S (SEQ ID NO: 1789) |
| SY | $X_{177}$ | M | $X_{178}$ (SEQ ID NO: 1790) | wherein $X_{177}$ is A or S; and $X_{178}$ is S, N or M.

Group 5

| | | | | |
|---|---|---|---|---|
| Y | YY | I | H (SEQ ID NO: 1791) |
| G | YY | L | H (SEQ ID NO: 1792) |
| G | YY | K | H (SEQ ID NO: 1793) |
| G | YY | T | H (SEQ ID NO: 1794) |
| G | YY | I | H (SEQ ID NO: 1795) |
| $X_{179}$ | YY | $X_{180}$ | H (SEQ ID NO: 1796) | wherein $X_{179}$ is Y or G; and $X_{180}$ is I, L, K or T.

Group 6

| | | | |
|---|---|---|---|
| SYG | I | H (SEQ ID NO: 1797) |
| SYG | L | H (SEQ ID NO: 1798) |
| SYG | $X_{181}$ | H (SEQ ID NO: 1799) | wherein $X_{181}$ is L or I.

Group 7

| | | | | |
|---|---|---|---|---|
| NY | G | M | H (SEQ ID NO: 1800) |
| NY | G | M | R (SEQ ID NO: 1801) |
| NY | N | M | H (SEQ ID NO: 1802) |
| NY | $X_{182}$ | M | $X_{183}$ (SEQ ID NO: 1803) | wherein $X_{182}$ is G or N; and $X_{183}$ is H, R or M.

Group 8

| | |
|---|---|
| S | YWIG (SEQ ID NO: 1804) |
| G | YWIG (SEQ ID NO: 1805) |
| $X_{184}$ | YWIG (SEQ ID NO: 1806) | wherein $X_{184}$ is S or G.

Group 9

| | | |
|---|---|---|
| GY | Y | MH (SEQ ID NO: 1807) |
| GY | F | MH (SEQ ID NO: 1808) |
| GY | $X_{185}$ | MH (SEQ ID NO: 1809) | wherein $X_{185}$ is Y or F.

Group 10

| | | | |
|---|---|---|---|
| S | Y | DI | N (SEQ ID NO: 1810) |
| S | H | DI | N (SEQ ID NO: 1811) |
| S | Y | DI | D (SEQ ID NO: 1812) |
| S | $X_{186}$ | DI | $X_{187}$ (SEQ ID NO: 1813) | wherein $X_{186}$ is Y or H; and $X_{187}$ is N or D.

Group 11

| | |
|---|---|
| N | YAMS (SEQ ID NO: 1814) |
| H | YAMS (SEQ ID NO: 1815) |
| $X_{188}$ | YAMS (SEQ ID NO: 1816) | wherein $X_{188}$ is N or H.

Group 12

NAWMS (SEQ ID NO: 1817)

Group 13

SSSYYWG (SEQ ID NO: 1818)

Group 14

| | |
|---|---|
| D | YYWN (SEQ ID NO: 1819) |
| S | YYWN (SEQ ID NO: 1820) |
| $X_{189}$ | YYWN (SEQ ID NO: 1821) | wherein $X_{189}$ is D or S.

Group 15

| | | |
|---|---|---|
| SNSA | T | WN (SEQ ID NO: 1822) |
| SNSA | A | WN (SEQ ID NO: 1823) |
| SNSA | $X_{190}$ | WN (SEQ ID NO: 1824) | wherein $X_{190}$ is T or A.

Group 16

| | |
|---|---|
| S | YDMH (SEQ ID NO: 1825) |
| T | YDMH (SEQ ID NO: 1826) |
| $X_{191}$ | YDMH (SEQ ID NO: 1827) | wherein $X_{191}$ is S or T.

In some cases an antigen binding protein comprises at least one heavy chain CDR1, CDR2, or CDR3 having one of the above consensus sequences. In some cases, an antigen binding protein comprises at least one light chain CDR1, CDR2, or CDR3 having one of the above consensus sequences. In other cases, the antigen binding protein comprises at least two heavy chain CDRs according to the determined consensus sequences, and/or at least two light chain CDRs according to the determined consensus sequences. In still other cases, the antigen binding protein comprises at least three heavy chain CDRs according to the determined consensus sequences, and/or at least three light chain CDRs according to the determined consensus sequences.

Exemplary Antigen Binding Proteins

According to one aspect, an isolated antigen binding protein comprising (a) one or more heavy chain complementary determining regions (CDRHs) comprising one or more of: (i) a CDRH1 selected from the group consisting of SEQ ID NOS 603-655; (ii) a CDRH2 selected from the group consisting of SEQ ID NOS 656-732; (iii) a CDRH3 selected from the group consisting of SEQ ID NOS 733-813; and (iv) a CDRH of (i), (ii) and (iii) that comprises ten, nine, eight, seven, six, five, four, three, two or one amino acid substitutions, deletions, insertions and combinations thereof; (b) one or more light chain complementary determining regions (CDRLs) comprising one or more of: (i) a CDRL1 selected from the group consisting of SEQ ID NOS 814-893; (ii) a CDRL2 comprising one or more of SEQ ID NOS 894-946; (iii) a CDRL3 comprising one or more of SEQ ID NOS 947-1020; and (iv) a CDRL of (i), (ii) and (iii) that comprises ten, nine, eight, seven, six, five, four, three, four, two or one amino acid substitutions, deletions or insertions and combinations thereof; or (c) one or more heavy chain CDRHs of (a) and one or more light chain CDRLs of (b).

In another embodiment, the CDRHs have at least 70%, 75%, 80%, 85%, 90%, 95%, 96%, 97%, 98% or 99% sequence identity with an amino acid sequence selected from the group consisting of SEQ ID NOS 603-813, and/or the CDRLs have at least 70%, 75%, 80%, 85%, 90%, 95%, 96%, 97%, 98% or 99% sequence identity with an amino acid sequence selected from the group consisting of SEQ ID NOS 814-1020. In a further embodiment, the VH is selected from the group consisting of SEQ ID NOS 316-409, and/or the $V_L$ is selected from the group consisting of SEQ ID NOS 217-315.

According to one aspect, an isolated antigen binding protein comprising (a) one or more variable heavy chains ($V_H$s) comprising one or more of: (i) SEQ ID NOS 316-409; and (ii) a $V_H$ of (i) that comprises ten, nine, eight, seven, six, five, four, three, two or one amino acid substitutions, deletions, insertions and combinations thereof; (b) one or more variable light chains ($V_L$s) selected from the group consisting of: (i) SEQ ID NOS 217-315, and (ii) a $V_L$ of (i) that comprises ten, nine, eight, seven, six, five, four, three, two or one amino acid substitutions, deletions, insertions and combinations thereof; or (c) one or more variable heavy chains of (a) and one or more variable light chains of (b).

In another embodiment, the variable heavy chain ($V_H$) has at least 70%, 75%, 80%, 85%, 90%, 95%, 96%, 97%, 98% or 99% sequence identity with an amino acid sequence selected from the group consisting of SEQ ID NOS 36-409, and/or the variable light chain ($V_L$) has at least 70%, 75%, 80%, 85%, 90%, 95%, 96%, 97%. 98% or 99% sequence identity with an amino acid sequence selected from the group consisting of SEQ ID NOS 217-315.

In one aspect, also provided is an antigen binding protein that specifically binds to a linear or three-dimensional epitope comprising one or more amino acid residues from FGFR1c, FGRF2c and FGFR3c.

In one aspect, also provided is an antigen binding protein that specifically binds to a linear or three-dimensional epitope comprising one or more amino acid residues from β-Klotho.

In another aspect, also provided is an isolated antigen binding protein that specifically binds to a linear or three-dimensional epitope comprising one or more amino acid residues from both β-Klotho and one or more amino acid residues from FGFR1c, FGFR2c and FGFR3c.

In yet another embodiment, the isolated antigen binding protein described hereinabove comprises a first amino acid sequence comprising at least one of the CDRH consensus sequences disclosed herein, and a second amino acid sequence comprising at least one of the CDRL consensus sequences disclosed herein.

In one aspect, the first amino acid sequence comprises at least two of the CDRH consensus sequences, and/or the second amino acid sequence comprises at least two of the CDRL consensus sequences. In certain embodiments, the first and the second amino acid sequence are covalently bonded to each other.

In a further embodiment, the first amino acid sequence of the isolated antigen binding protein comprises the CDRH3, the CDRH2 and the CDRH1 parings shown in Table 5 for each clone, and/or the second amino acid sequence of the isolated antigen binding protein comprises the CDRL3, the CDRL2 and the CDRL1 pairings shown in Table 4 or each clone.

In a further embodiment, the antigen binding protein comprises at least two CDRH sequences of heavy chain sequences H1, H2, H3, H4, H5, H6, H7, H8, H9, H10, H11, H12, H13, H14, H15, H16, H17 or H18, H19, H20, H21, H22, H23, H24, H25, H26, H27, H28, H29, H30, H31, H32, H33, H34, H35, H36, H37, H38, H39, H40, H41, H42, H43, H44, H45, H146, H46, H48, H49, H50, H51, H52, H53, H54, H55, H56, H57, H58, H59, H60, H61, H62, H63, H64, H65, H66, H67, H68, H69, H70, H71, H72, H73, H74, H75, H76, H77, H78, H79, H80, H81, H82, H83, H84, H85, H86, H87, H88, H89, H90, H91, H92, H93 and H94, as shown in Tables 3A and 4A.

In again a further embodiment, the antigen binding protein comprises at least two CDRL sequences of light chain sequences L1, L2, L3, L4, L5, L6, L7, L8, L9, L10, L11, L12, L13, L14, L15, L16, L17, L18, L19, L20, L21, L22, L23, L24, L25, L26, L27, L28, L29, L30, L31, L32, L33, L34, L35, L36, L37, L38, L39, L40, L41, L42, L43, L44, L45, L46, L47, L48, L49, L50, L51, L52, L53, L54, L55, L56, L57, L58, L59, L60, L61, L62, L63, L64, L65, L66, L67, L68, L69, L70, L71, L72, L73, L74, L75, L76, L77, L78, L79, L80, L81, L82, L83, L84, L85, L86, L87, L88, L89, L90, L91, L92, L93, L94, L95, L96, L97, L98, L99 and L100, as shown in Tables 3B and 4B.

In still a further embodiment, the antigen binding protein comprises at least two CDRH sequences of heavy chain sequences H1, H2, H3, H4, H5, H6, H7, H8, H9, H10, H11, H12, H13, H14, H15, H16, H17 or H18, H19, H20, H21, H22, H23, H24, H25, H26, H27, H28, H29, H30, H31, H32, H33, H34, H35, H36, H37, H38, H39, H40, H41, H42, H43, H44, H45, H146, H46, H48, H49, H50, H51, H52, H53, H54, H55, H56, H57, H58, H59, H60, H61, H62, H63, H64, H65, H66, H67, H68, H69, H70, H71, H72, H73, H74, H75, H76, H77, H78, H79, H80, H81, H82, H83, H84, H85, H86, H87, H88, H89, H90, H91, H92, H93 and H94, as shown in Tables 3A and 4A, and at least two CDRLs of light chain sequences L1, L2, L3, L4, L5, L6, L7, L8, L9, L10, L11, L12, L13, L14, L15, L16, L17, L18, L19, L20, L21, L22, L23, L24, L25, L26, L27, L28, L29, L30, L31, L32, L33, L34, L35, L36, L37, L38, L39, L40, L41, L42, L43, L44, L45, L46, L47, L48, L49, L50, L51, L52, L53, L54, L55, L56, L57, L58, L59, L60, L61, L62, L63, L64, L65, L66, L67, L68, L69, L70, L71, L72, L73, L74, L75, L76, L77, L78, L79, L80, L81, L82, L83, L84, L85, L86, L87, L88, L89, L90, L91, L92, L93, L94, L95, L96, L97, L98, L99 and L100, as shown in Tables 3B and 4B.

In again another embodiment, the antigen binding protein comprises the CDRH1, CDRH2, and CDRH3 sequences of heavy chain sequences H1, H2, H3, H4, H5, H6, H7, H8, H9, H10, H11, H12, H13, H14, H15, H16, H17 or H18, H19, H20, H21, H22, H23, H24, H25, H26, H27, H28, H29, H30, H31, H32, H33, H34, H35, H36, H37, H38, H39, H40, H41, H42, H43, H44, H45, H146, H46, H48, H49, H50, H51, H52, H53, H54, H55, H56, H57, H58, H59, H60, H61, H62, H63, H64, H65, H66, H67, H68, H69, H70, H71, H72, H73, H74, H75, H76, H77, H78, H79, H80, H81, H82, H83, H84, H85, H86, H87, H88, H89, H90, H91, H92, H93 and H94, as shown in Tables 3A and 4A.

In yet another embodiment, the antigen binding protein comprises the CDRL1, CDRL2, and CDRL3 sequences of light chain sequences L1, L2, L3, L4, L5, L6, L7, L8, L9, L10, L11, L12, L13, L14, L15, L16, L17, L18, L19, L20, L21, L22, L23, L24, L25, L26, L27, L28, L29, L30, L31, L32, L33, L34, L35, L36, L37, L38, L39, L40, L41, L42, L43, L44, L45, L46, L47, L48, L49, L50, L51, L52, L53, L54, L55, L56, L57, L58, L59, L60, L61, L62, L63, L64, L65, L66, L67, L68, L69, L70, L71, L72, L73, L74, L75, L76, L77, L78, L79, L80, L81, L82, L83, L84, L85, L86, L87, L88, L89, L90, L91, L92, L93, L94, L95, L96, L97, L98, L99 and L100, as shown in Tables 3B and 4B.

In yet another embodiment, the antigen binding protein comprises all six CDRs of an antigen binding protein comprising the following $V_H$ and $V_L$ pairs: $V_L1$ with $V_H1$; $V_L2$ with $V_H1$; $V_L3$ with $V_H2$ or $V_H3$; $V_L4$ with $V_H4$; $V_L5$ with $V_H5$; $V_L6$ with $V_H6$; $V_L7$ with $V_H6$; $V_L8$ with $V_H7$ or $V_H8$; $V_L9$ with $V_H9$; $V_L10$ with $V_H9$; $V_L11$ with $V_H10$; $V_L12$ with $V_H11$; $V_L13$ with $V_H12$; $V_L13$ with $V_H14$; $V_L14$ with $V_H13$; $V_L15$ with $V_H14$; $V_L16$ with $V_H15$; $V_L17$ with $V_H16$; $V_L18$ with $V_H17$; $V_L19$ with $V_H18$; $V_L20$ with $V_H19$; $V_L21$ with $V_H20$; $V_L22$ with $V_H21$; $V_L23$ with $V_H22$; $V_L24$ with $V_H23$; $V_L25$ with $V_H24$; $V_L26$ with $V_H25$; $V_L27$ with $V_H26$; $V_L28$ with $V_H27$; $V_L29$ with $V_H28$; $V_L30$ with $V_H29$; $V_L31$ with $V_H30$; $V_L32$ with $V_H31$; $V_L33$ with $V_H32$; $V_L34$ with $V_H33$; $V_L35$ with $V_H34$; $V_L36$ with $V_H35$; $V_L37$ with $V_H36$; $V_L38$ with $V_H37$; $V_L39$ with $V_H38$; $V_L40$ with $V_H39$; $V_L41$ with $V_H40$; $V_L42$ with $V_H41$; $V_L43$ with $V_H42$; $V_L44$ with $V_H43$; $V_L45$ with $V_H44$; $V_L46$ with $V_H45$; $V_L47$ with $V_H46$; $V_L48$ with $V_H47$; $V_L49$ with $V_H48$; $V_L50$ with $V_H49$; $V_L51$ with $V_H50$; $V_L52$ with $V_H51$; $V_L53$ with $V_H52$; $V_L54$ with $V_H53$; $V_L55$ with $V_H54$; $V_L56$ with $V_H54$; $V_L57$ with $V_H54$; $V_L58$ with $V_H55$; $V_L59$ with $V_H56$; $V_L60$ with $V_H57$; $V_L61$ with $V_H58$; $V_L62$ with $V_H59$; $V_L63$ with $V_H60$; $V_L64$ with $V_H1$; $V_L65$ with $V_H62$; $V_L66$ with $V_H63$; $V_L67$ with $V_H64$; $V_L68$ with $V_H65$; $V_L69$ with $V_H66$; $V_L70$ with $V_H67$; $V_L71$ with $V_H68$; $V_L72$ with $V_H69$; $V_L73$ with $V_H70$; $V_L74$ with $V_H70$; $V_L75$ with $V_H70$; $V_L76$ with $V_H71$; $V_L77$ with $V_H72$; $V_L78$ with $V_H73$; $V_L79$ with $V_H74$; $V_L80$ with $V_H75$; $V_L81$ with $V_H76$; $V_L82$ with $V_H77$; $V_L83$ with $V_H78$; $V_L84$ with $V_H79$; $V_L85$ with $V_H80$; $V_L86$ with $V_H81$; $V_L87$ with $V_H82$; $V_L88$ with $V_H86$; $V_L89$ with $V_H83$; $V_L90$ with $V_H84$; $V_L91$ with $V_H85$; $V_L92$ with $V_H87$; $V_L93$ with $V_H88$; $V_L94$ with $V_H88$; $V_L95$ with $V_H89$; $V_L96$ with $V_H90$; $V_L97$ with $V_H91$; $V_L98$ with $V_H92$; $V_L99$ with $V_H93$; and $V_L100$ with $V_H94$; as shown in Tables 2A and 2B and Tables 4A and 4B.

TABLE 7A

Heavy Chain Sequences

| Ref | Full Heavy (H#) | Full Heavy SEQ ID NO | Variable Heavy (VH#) | Variable Heavy SEQ ID NO | CDRH1 SEQ ID NO | CDRH2 SEQ ID NO | CDRH3 SEQ ID NO |
|---|---|---|---|---|---|---|---|
| 63G8 | H1 | 123 | $V_H1$ | 326 | 636 | 667 | 782 |
| 68D3 | | | | | | | |
| 64A8 | | | | | | | |
| 67B4 | | | | | | | |
| 64E6 | H2 | 136 | $V_H2$ | 339 | 637 | 699 | 783 |
| 65E8 | | | | | | | |
| 65F11 | | | | | | | |
| 67G7 | | | | | | | |
| 63H11 | H3 | 135 | $V_H3$ | 338 | 637 | 689 | 783 |
| 63B6 | H4 | 133 | $V_H4$ | 336 | 638 | 700 | 784 |
| 64D4 | | | | | | | |
| 65C3 | H5 | 142 | $V_H5$ | 345 | 626 | 701 | 785 |
| 68D5 | | | | | | | |
| 63E6 | H6 | 113 | $V_H6$ | 316 | 639 | 702 | 786 |
| 66F7 | | | | | | | |
| 64H5 | H7 | 126 | $V_H7$ | 329 | 614 | 703 | 787 |
| 65G4 | H8 | 129 | $V_H8$ | 332 | 614 | 703 | 787 |
| 67G10v1 | H9 | 121 | $V_H9$ | 324 | 640 | 704 | 788 |
| 67G10v2 | | | | | | | |
| 66B4 | H10 | 115 | $V_H10$ | 318 | 617 | 708 | 791 |
| 66G2 | H11 | 124 | $V_H11$ | 327 | 614 | 709 | 782 |
| 68G5 | H12 | 130 | $V_H12$ | 333 | 614 | 710 | 792 |
| 63F5 | H13 | 134 | $V_H13$ | 337 | 637 | 705 | 783 |
| 66F6 | H14 | 138 | $V_H14$ | 341 | 637 | 689 | 783 |
| 65C1 | H15 | 137 | $V_H15$ | 340 | 637 | 707 | 790 |
| 64A7 | H16 | 141 | $V_H16$ | 344 | 642 | 706 | 789 |
| 66D4 | H17 | 114 | $V_H17$ | 317 | 645 | 711 | 793 |
| 65B1 | H18 | 116 | $V_H18$ | 319 | 646 | 712 | 794 |
| 67A4 | H19 | 118 | $V_H19$ | 321 | 647 | 713 | 795 |
| 65B4 | H20 | 117 | $V_H20$ | 320 | 648 | 714 | 796 |
| 63A10 | H21 | 119 | $V_H21$ | 322 | 640 | 715 | 788 |
| 65H11 | H22 | 120 | $V_H22$ | 323 | 640 | 716 | 788 |

TABLE 7A-continued

Heavy Chain Sequences

| Ref | Full Heavy (H#) | Full Heavy SEQ ID NO | Variable Heavy (VH#) | Variable Heavy SEQ ID NO | CDRH1 SEQ ID NO | CDRH2 SEQ ID NO | CDRH3 SEQ ID NO |
|---|---|---|---|---|---|---|---|
| 64C8 | H23 | 122 | $V_H23$ | 325 | 614 | 717 | 797 |
| 65E3 | H24 | 128 | $V_H24$ | 331 | 649 | 718 | 798 |
| 65D4 | H25 | 127 | $V_H25$ | 330 | 650 | 677 | 799 |
| 65D1 | H26 | 125 | $V_H26$ | 328 | 651 | 719 | 800 |
| 67G8 | H27 | 131 | $V_H27$ | 334 | 614 | 720 | 801 |
| 65B7 | H28 | 132 | $V_H28$ | 335 | 652 | 707 | 802 |
| 64A6 | H29 | 139 | $V_H29$ | 342 | 616 | 721 | 803 |
| 65F9 | H30 | 140 | $V_H30$ | 343 | 638 | 689 | 804 |
| 67F5 | H31 | 143 | $V_H31$ | 346 | 626 | 722 | 785 |
| 64B10 | H32 | 144 | $V_H32$ | 347 | 638 | 723 | 805 |
| 68C8 | H33 | 145 | $V_H33$ | 348 | 653 | 724 | 806 |
| 67A5 | H34 | 146 | $V_H34$ | 349 | 627 | 686 | 807 |
| 67C10 | H35 | 147 | $V_H35$ | 350 | 627 | 686 | 808 |
| 64H6 | H36 | 148 | $V_H36$ | 351 | 627 | 725 | 809 |
| 63F9 | H37 | 149 | $V_H37$ | 352 | 654 | 726 | 810 |
| 67F6 | H38 | 150 | $V_H38$ | 353 | 655 | 686 | 811 |
| 48H11 | H39 | 154 | $V_H39$ | 357 | 606 | 659 | 736 |
| 52A8 | H40 | 164 | $V_H40$ | 368 | 617 | 672 | 749 |
| 52F8 | H41 | 167 | $V_H41$ | 371 | 619 | 675 | 753 |
| 49H12 | H42 | 159 | $V_H42$ | 362 | 612 | 665 | 742 |
| 54A1 55G9 | H43 | 172 | $V_H43$ | 376 | 612 | 680 | 742 |
| 49C8 52H1 | H44 | 156 | $V_H44$ | 359 | 609 | 662 | 739 |
| 60G5.2 | H45 | 193 | $V_H45$ | 397 | 635 | 697 | 780 |
| 49G3 | H46 | 158 | $V_H46$ | 361 | 611 | 664 | 741 |
| 59A10 49H4 | H47 | 187 | $V_H47$ | 391 | 632 | 692 | 773 |
| 48F8 53B9 56B4 57E7 57F11 | H48 | 153 | $V_H48$ | 356 | 605 | 658 | 735 |
| 59C9 58A5 57A4 57F9 | H49 | 188 | $V_H49$ | 392 | 633 | 693 | 774 |
| 51G2 | H50 | 163 | $V_H50$ | 367 | 605 | 671 | 748 |
| 56A7 56E4 | H51 | 179 | $V_H51$ | 383 | 605 | 671 | 764 |
| 54H10 55D1 48H3 53C11 | H52 | 173 | $V_H52$ | 377 | 623 | 681 | 759 |
| 59G10.3 | H53 | 190 | $V_H53$ | 394 | 634 | 695 | 777 |
| 59D10v1 59D10v2 51C10.1 | H54 | 195 | $V_H54$ | 364 | 615 | 668 | 745 |
| 60F9 48B4 52D6 | H55 | 192 | $V_H55$ | 396 | 623 | 696 | 779 |
| 61G5 | H56 | 194 | $V_H56$ | 398 | 623 | 698 | 781 |
| 59G10.2 | H57 | 189 | $V_H57$ | 393 | 608 | 694 | 776 |
| 51A8 | H58 | 160 | $V_H58$ | 363 | 614 | 667 | 744 |
| 53H5.2 | H59 | 170 | $V_H59$ | 374 | 614 | 678 | 756 |
| 53F6 | H60 | 169 | $V_H60$ | 373 | 621 | 677 | 755 |
| 56C11 | H61 | 180 | $V_H61$ | 384 | 614 | 685 | 765 |
| 49A10 48D4 | H62 | 155 | $V_H62$ | 358 | 608 | 661 | 738 |
| 49G2 50C12 55G11 | H63 | 157 | $V_H63$ | 360 | 610 | 663 | 740 |
| 52C1 | H64 | 166 | $V_H64$ | 370 | 614 | 674 | 751 |
| 55E9 | H65 | 176 | $V_H65$ | 380 | 625 | 683 | 762 |
| 60D7 | H66 | 191 | $V_H66$ | 395 | 614 | 677 | 778 |
| 51C10.2 | H67 | 161 | $V_H67$ | 365 | 616 | 669 | 746 |
| 55D3 | H68 | 174 | $V_H68$ | 378 | 624 | 682 | 760 |
| 57B12 | H69 | 184 | $V_H69$ | 388 | 630 | 689 | 760 |
| 55E4 52C5 60G5.1 55E4 49B11 50H10 53C1 | H70 | 175 | $V_H70$ | 379 | 604 | 656 | 752 |

TABLE 7A-continued

Heavy Chain Sequences

| Ref | Full Heavy (H#) | Full Heavy SEQ ID NO | Variable Heavy (VH#) | Variable Heavy SEQ ID NO | CDRH1 SEQ ID NO | CDRH2 SEQ ID NO | CDRH3 SEQ ID NO |
|---|---|---|---|---|---|---|---|
| 56G1 | H71 | 182 | $V_H71$ | 386 | 604 | 656 | 752 |
| 48F3 | H72 | 152 | $V_H72$ | 355 | 604 | 657 | 734 |
| 48C9 49A12 51E2 | H73 | 151 | $V_H73$ | 354 | 603 | 656 | 733 |
| 51E5 | H74 | 162 | $V_H74$ | 366 | 604 | 670 | 747 |
| 53H5.3 | H75 | 171 | $V_H75$ | 375 | 622 | 679 | 757 |
| 56G3.3 55B10 | H76 | 183 | $V_H76$ | 387 | 629 | 688 | 769 |
| 52B8 | H77 | 165 | $V_H77$ | 369 | 618 | 673 | 750 |
| 55G5 | H78 | 177 | $V_H78$ | 381 | 626 | 684 | 763 |
| 52H2 | H79 | 168 | $V_H79$ | 372 | 620 | 676 | 754 |
| 56G3.2 | H80 | 196 | $V_H80$ | 399 | 628 | 687 | 768 |
| 56E7 | H81 | 181 | $V_H81$ | 385 | 627 | 686 | 766 |
| 57D9 | H82 | 185 | $V_H82$ | 389 | 631 | 690 | 771 |
| 48G4 53C3.1 | H83 | 197 | $V_H83$ | 400 | 607 | 660 | 737 |
| 50G1 | H84 | 178 | $V_H84$ | 382 | 613 | 666 | 743 |
| 58C2 | H85 | 186 | $V_H85$ | 390 | 608 | 691 | 772 |
| 61H5 52B9 | H86 | 198 | $V_H86$ | 401 | 629 | 727 | 769 |
| 50D4 | H87 | 199 | $V_H87$ | 402 | 643 | 730 | 812 |
| 50G5v1 50G5v2 | H88 | 200 | $V_H88$ | 403 | 639 | 728 | 767 |
| 51C1 | H89 | 201 | $V_H89$ | 404 | 604 | 656 | 752 |
| 53C3.2 | H90 | 202 | $V_H90$ | 405 | 641 | 732 | 775 |
| 54H10.3 | H91 | 203 | $V_H91$ | 406 | 645 | 729 | 813 |
| 55A7 | H92 | 204 | $V_H92$ | 407 | 626 | 673 | 770 |
| 55E6 | H93 | 205 | $V_H93$ | 408 | 605 | 731 | 761 |
| 61E1 | H94 | 206 | $V_H94$ | 409 | 644 | 690 | 758 |

TABLE 7B

Light Chain Sequences

| Ref | Full Light (L#) | Full Light SEQ ID NO | Variable Light (VH#) | Variable Light SEQ ID NO | CDRL1 SEQ ID NO | CDRL2 SEQ ID NO | CDRL3 SEQ ID NO |
|---|---|---|---|---|---|---|---|
| 63G8 64A8 67B4 | L1 | 26 | $V_L1$ | 229 | 826 | 922 | 987 |
| 68D3 | L2 | 28 | $V_L2$ | 231 | 826 | 922 | 987 |
| 65E8 63H11 64E6 67G7 65F11 | L3 | 37 | $V_L3$ | 241 | 859 | 927 | 988 |
| 63B6 64D4 | L4 | 35 | $V_L4$ | 239 | 860 | 928 | 989 |
| 65C3 68D5 | L5 | 43 | $V_L5$ | 247 | 861 | 929 | 990 |
| 63E6 | L6 | 14 | $V_L6$ | 217 | 862 | 907 | 991 |
| 66F7 | L7 | 15 | $V_L7$ | 218 | 863 | 907 | 991 |
| 64H5 65G4 | L8 | 30 | $V_L8$ | 233 | 864 | 930 | 992 |
| 67G10v1 | L9 | 23 | $V_L9$ | 226 | 865 | 931 | 993 |
| 67G10v2 | L10 | 24 | $V_L10$ | 227 | 866 | 932 | 994 |
| 66B4 | L11 | 17 | $V_L11$ | 220 | 870 | 933 | 996 |
| 66G2 | L12 | 27 | $V_L12$ | 230 | 835 | 934 | 997 |
| 68G5 | L13 | 100 | $V_L13$ | 236 | 872 | 935 | 998 |
| 63F5 | L14 | 36 | $V_L14$ | 240 | 867 | 913 | 988 |
| 66F6 | L15 | 39 | $V_L15$ | 243 | 859 | 928 | 988 |
| 65C1 | L16 | 38 | $V_L16$ | 242 | 869 | 928 | 988 |
| 64A7 | L17 | 42 | $V_L17$ | 246 | 868 | 913 | 995 |
| 66D4 | L18 | 16 | $V_L18$ | 219 | 873 | 907 | 999 |
| 65B1 | L19 | 18 | $V_L19$ | 221 | 874 | 936 | 961 |
| 67A4 | L20 | 20 | $V_L20$ | 223 | 875 | 918 | 1001 |
| 65B4 | L21 | 19 | $V_L21$ | 222 | 876 | 918 | 1001 |
| 63A10 | L22 | 21 | $V_L22$ | 224 | 865 | 938 | 1002 |
| 65H11 | L23 | 22 | $V_L23$ | 225 | 878 | 931 | 1003 |
| 64C8 | L24 | 25 | $V_L24$ | 228 | 879 | 940 | 1004 |
| 65E3 | L25 | 32 | $V_L25$ | 235 | 864 | 935 | 1005 |

TABLE 7B-continued

Light Chain Sequences

| Ref | Full Light (L#) | Full Light SEQ ID NO | Variable Light (VH#) | Variable Light SEQ ID NO | CDRL1 SEQ ID NO | CDRL2 SEQ ID NO | CDRL3 SEQ ID NO |
|---|---|---|---|---|---|---|---|
| 65D4 | L26 | 31 | $V_L26$ | 234 | 880 | 935 | 1006 |
| 65D1 | L27 | 29 | $V_L27$ | 232 | 852 | 925 | 1007 |
| 67G8 | L28 | 33 | $V_L28$ | 237 | 882 | 930 | 1005 |
| 65B7 | L29 | 34 | $V_L29$ | 238 | 883 | 913 | 1008 |
| 64A6 | L30 | 40 | $V_L30$ | 244 | 884 | 941 | 1009 |
| 65F9 | L31 | 41 | $V_L31$ | 245 | 885 | 908 | 1009 |
| 67F5 | L32 | 44 | $V_L32$ | 248 | 885 | 942 | 1010 |
| 64B10 | L33 | 45 | $V_L33$ | 249 | 886 | 943 | 963 |
| 68C8 | L34 | 46 | $V_L34$ | 250 | 887 | 909 | 963 |
| 67A5 | L35 | 47 | $V_L35$ | 251 | 888 | 898 | 1012 |
| 67C10 | L36 | 48 | $V_L36$ | 252 | 888 | 898 | 951 |
| 64H6 | L37 | 49 | $V_L37$ | 253 | 864 | 930 | 1014 |
| 63F9 | L38 | 50 | $V_L38$ | 254 | 889 | 944 | 1015 |
| 67F6 | L39 | 51 | $V_L39$ | 255 | 890 | 945 | 951 |
| 48H11 | L40 | 55 | $V_L40$ | 259 | 817 | 897 | 950 |
| 52A8 | L41 | 66 | $V_L41$ | 270 | 828 | 907 | 961 |
| 52F8 | L42 | 69 | $V_L42$ | 273 | 832 | 910 | 965 |
| 49H12 | L43 | 60 | $V_L43$ | 264 | 822 | 901 | 955 |
| 54A1 55G9 | L44 | 74 | $V_L44$ | 278 | 837 | 899 | 955 |
| 49C8 52H1 | L45 | 57 | $V_L45$ | 261 | 819 | 899 | 952 |
| 60G5.2 | L46 | 93 | $V_L46$ | 297 | 857 | 925 | 986 |
| 49G3 | L47 | 59 | $V_L47$ | 263 | 821 | 900 | 954 |
| 59A10 49H4 | L48 | 87 | $V_L48$ | 291 | 827 | 921 | 960 |
| 48F8 53B9 56B4 57E7 57F11 | L49 | 54 | $V_L49$ | 258 | 816 | 896 | 949 |
| 59C9 58A5 57A4 57F9 | L50 | 88 | $V_L50$ | 292 | 850 | 922 | 960 |
| 51G2 | L51 | 65 | $V_L51$ | 269 | 827 | 906 | 960 |
| 56A7 56E4 | L52 | 80 | $V_L52$ | 284 | 842 | 917 | 960 |
| 54H10.1 55D1 48H3 53C11 | L53 | 75 | $V_L53$ | 279 | 838 | 913 | 970 |
| 59G10.3 | L54 | 90 | $V_L54$ | 294 | 854 | 909 | 983 |
| 51C10.1 | L55 | 62 | $V_L55$ | 266 | 824 | 903 | 957 |
| 59D10v1 | L56 | 97 | $V_L56$ | 301 | 851 | 903 | 980 |
| 59D10v2 | L57 | 98 | $V_L57$ | 302 | 852 | 923 | 981 |
| 60F9 48B4 52D6 | L58 | 92 | $V_L58$ | 296 | 856 | 924 | 985 |
| 61G5 | L59 | 94 | $V_L59$ | 298 | 858 | 926 | 985 |
| 59G10.2 | L60 | 89 | $V_L60$ | 293 | 853 | 904 | 982 |
| 51A8 | L61 | 61 | $V_L61$ | 265 | 823 | 902 | 956 |
| 53H5.2 | L62 | 72 | $V_L62$ | 276 | 835 | 907 | 968 |
| 53F6 | L63 | 71 | $V_L63$ | 275 | 834 | 912 | 967 |
| 56C11 | L64 | 81 | $V_L64$ | 285 | 843 | 918 | 974 |
| 49A10 48D4 | L65 | 56 | $V_L65$ | 260 | 818 | 898 | 951 |
| 49G2 50C12 55G11 | L66 | 58 | $V_L66$ | 262 | 820 | 898 | 953 |
| 52C1 | L67 | 68 | $V_L67$ | 272 | 830 | 909 | 963 |
| 55E9 | L68 | 78 | $V_L68$ | 282 | 840 | 910 | 972 |
| 60D7 | L69 | 91 | $V_L69$ | 295 | 820 | 898 | 984 |
| 51C10.2 | L70 | 63 | $V_L70$ | 267 | 825 | 904 | 958 |
| 55D3 | L71 | 76 | $V_L71$ | 280 | 839 | 907 | 971 |
| 57B12 | L72 | 85 | $V_L72$ | 289 | 847 | 907 | 978 |
| 52C5 | L73 | 95 | $V_L73$ | 299 | 831 | 907 | 964 |
| 60G5.1 | L74 |  | $V_L74$ |  |  |  |  |
| 55E4 49B11 50H10 53C1 | L75 | 77 | $V_L75$ | 281 | 831 | 914 | 964 |
| 56G1 | L76 | 83 | $V_L76$ | 287 | 831 | 907 | 976 |
| 48F3 | L77 | 53 | $V_L77$ | 257 | 815 | 895 | 948 |
| 48C9 | L78 | 52 | $V_L78$ | 256 | 814 | 894 | 947 |

TABLE 7B-continued

Light Chain Sequences

| Ref | Full Light (L#) | Full Light SEQ ID NO | Variable Light (VH#) | Variable Light SEQ ID NO | CDRL1 SEQ ID NO | CDRL2 SEQ ID NO | CDRL3 SEQ ID NO |
|---|---|---|---|---|---|---|---|
| 49A12 | | | | | | | |
| 51E2 | | | | | | | |
| 51E5 | L79 | 64 | V$_L$79 | 268 | 826 | 905 | 959 |
| 53H5.3 | L80 | 73 | V$_L$80 | 277 | 836 | 908 | 969 |
| 56G3.3 | L81 | 84 | V$_L$81 | 288 | 846 | 920 | 977 |
| 55B10 | | | | | | | |
| 52B8 | L82 | 67 | V$_L$82 | 271 | 829 | 908 | 962 |
| 55G5 | L83 | 79 | V$_L$83 | 283 | 841 | 916 | 973 |
| 52H2 | L84 | 70 | V$_L$84 | 274 | 833 | 911 | 966 |
| 56G3.2 | L85 | 99 | V$_L$85 | 303 | 845 | 919 | 962 |
| 56E7 | L86 | 82 | V$_L$86 | 286 | 844 | 900 | 975 |
| 57D9 | L87 | 86 | V$_L$87 | 290 | 848 | 913 | 976 |
| 61H5 | L88 | 96 | V$_L$88 | 300 | 846 | 913 | 977 |
| 52B9 | | | | | | | |
| 48G4 | L89 | 101 | V$_L$89 | 304 | 892 | 928 | 1017 |
| 53C3.1 | | | | | | | |
| 50G1 | L90 | 102 | V$_L$90 | 305 | 820 | 898 | 984 |
| 58C2 | L91 | 103 | V$_L$91 | 306 | 893 | 898 | 1012 |
| 50D4 | L92 | 104 | V$_L$92 | 307 | 839 | 946 | 1019 |
| 50G5v1 | L93 | 105 | V$_L$93 | 308 | 835 | 907 | 1018 |
| 50G5v2 | L94 | 106 | V$_L$94 | 309 | 891 | 915 | 1020 |
| 51C1 | L95 | 107 | V$_L$95 | 310 | 831 | 907 | 964 |
| 53C3.2 | L96 | 108 | V$_L$96 | 311 | 849 | 937 | 1016 |
| 54H10.3 | L97 | 109 | V$_L$97 | 312 | 855 | 939 | 999 |
| 55A7 | L98 | 110 | V$_L$98 | 313 | 871 | 907 | 1000 |
| 55E6 | L99 | 111 | V$_L$99 | 314 | 877 | 913 | 1011 |
| 61E1 | L100 | 112 | V$_L$100 | 315 | 881 | 907 | 1013 |

In one aspect, the isolated antigen binding proteins that specifically bind to a complex comprising β-Klotho and at least one of (i) FGFR1c, (ii) FGFR2c and (iii) FGFR3c provided herein can be a monoclonal antibody, a polyclonal antibody, a recombinant antibody, a human antibody, a humanized antibody, a chimeric antibody, a multispecific antibody, or an antibody fragment thereof.

In another embodiment, the antibody fragment of the isolated antigen-binding proteins provided herein can be a Fab fragment, a Fab' fragment, an F(ab')$_2$ fragment, an Fv fragment, a diabody, or a single chain antibody molecule.

In a further embodiment, an isolated antigen binding protein that specifically binds to a complex comprising β-Klotho and at least one of (i) FGFR1c, (ii) FGFR2c and (iii) FGFR3c provided herein is a human antibody and can be of the IgG1-, IgG2-IgG3- or IgG4-type.

In another embodiment, an isolated antigen binding protein that specifically binds to a complex comprising β-Klotho and at least one of (i) FGFR1c, (ii) FGFR2c and (iii) FGFR3c comprises a light or a heavy chain polypeptide as set forth in Tables 1A-1B. In some embodiments, an antigen binding protein that specifically binds to a complex comprising β-Klotho and at least one of (i) FGFR1c, (ii) FGFR2c and (iii) FGFR3c comprises a variable light or variable heavy domain such as those listed in Tables 2A-2B. In still other embodiments, an antigen binding protein that specifically binds to a complex comprising β-Klotho and at least one of (i) FGFR1c, (ii) FGFR2c and (iii) FGFR3c comprises one, two or three CDRHs or one, two or three CDRLs as set forth in Tables 3A-3B, 4A-4B, infra. Such antigen binding proteins, and indeed any of the antigen binding proteins disclosed herein, can be PEGylated with one or more PEG molecules, for examples PEG molecules having a molecular weight selected from the group consisting of 5K, 10K, 20K, 40K, 50K, 60K, 80K, 100K or greater than 100K.

In yet another aspect, any antigen binding protein that specifically binds to a complex comprising β-Klotho and at least one of (i) FGFR1c, (ii) FGFR2c and (iii) FGFR3c provided herein can be coupled to a labeling group and can compete for binding to the extracellular portion of the individual protein components of a complex comprising β-Klotho and at least one of (i) FGFR1c, (ii) FGFR2c and (iii) FGFR3c with an antigen binding protein of one of the isolated antigen binding proteins provided herein. In one embodiment, the isolated antigen binding protein provided herein can reduce blood glucose levels, decrease triglyceride and cholesterol levels or improve other glycemic parameters and cardiovascular risk factors when administered to a patient.

As will be appreciated, for any antigen binding protein comprising more than one CDR provided in Tables 3A-3B, and 4A-4B, any combination of CDRs independently selected from the depicted sequences may be useful. Thus, antigen binding proteins with one, two, three, four, five or six of independently selected CDRs can be generated. However, as will be appreciated by those in the art, specific embodiments generally utilize combinations of CDRs that are non-repetitive, e.g., antigen binding proteins are generally not made with two CDRH2 regions, etc.

Some of the antigen binding proteins that specifically bind to a complex comprising β-Klotho and at least one of (i) FGFR1c, (ii) FGFR2c and (iii) FGFR3c that are provided herein are discussed in more detail below.

Antigen Binding Proteins and Binding Epitopes and Binding Domains

When an antigen binding protein is said to bind an epitope on a complex β-Klotho and at least one of (i) FGFR1c, (ii) FGFR2c and (iii) FGFR3c, or the extracellular domain of a protein component of such a complex, what is meant is that the antigen binding protein specifically binds to a specified portion of the complex comprising β-Klotho and an FGFR (e.g., FGFR1c, FGFR2c or FGFR3c) or to the extracellular domain of such a complex. In some embodiments, e.g., in certain cases where the antigen binding protein binds only β-Klotho, the antigen binding protein can specifically bind to a polypeptide consisting of specified residues (e.g., a specified segment of β-Klotho). In other embodiments, e.g., in certain cases where an antigen binding protein interacts with both β-Klotho and at least one of (i) FGFR1c, (ii) FGFR2c and (iii) FGFR3c, the antigen binding protein can bind residues, sequences of residues, or regions in both β-Klotho and at least one of (i) FGFR1c, (ii) FGFR2c and (iii) FGFR3c, depending on which receptor the antigen binding protein recognizes. In still other embodiments the antigen binding protein will bind residues, sequences or residues or regions of a complex comprising β-Klotho and at least one of (i) FGFR1c, (ii) FGFR2c and (iii) FGFR3c, for example FGFR1c.

In any of the foregoing embodiments, such an antigen binding protein does not need to contact every residue of β-Klotho or a complex comprising β-Klotho and at least one of (i) FGFR1c, (ii) FGFR2c and (iii) FGFR3c, or the extracellular domain of the recited proteins or complexes. Nor does every single amino acid substitution or deletion within β-Klotho or a complex comprising β-Klotho and at least one of (i) FGFR1c, (ii) FGFR2c and (iii) FGFR3c, or the extracellular domain of the recited proteins or complexes, necessarily significantly affect binding affinity.

Epitope specificity and the binding domain(s) of an antigen binding protein can be determined by a variety of methods. Some methods, for example, can use truncated portions of an antigen. Other methods utilize antigen mutated at one or more specific residues, such as by employing an alanine scanning or arginine scanning-type approach or by the generation and study of chimeric proteins in which various domains, regions or amino acids are swapped between two proteins (e.g., mouse and human forms of one or more of the antigens or target proteins), or by protease protection assays.

Competing Antigen Binding Proteins

In another aspect, antigen binding proteins are provided that compete with one of the exemplified antibodies or functional fragments for binding to a complex comprising β-Klotho and at least one of (i) FGFR1c, (ii) FGFR2c and (iii) FGFR3c. Such antigen binding proteins can also bind to the same epitope as one of the herein exemplified antigen binding proteins, or an overlapping epitope. Antigen binding proteins and fragments that compete with or bind to the same epitope as the exemplified antigen binding proteins are expected to show similar functional properties. The exemplified antigen binding proteins and fragments include those with the heavy and light chains H1-H94 and L1-L100, variable region domains $V_L1$-$V_L100$ and $V_H1$-$V_H94$, and CDRs provided herein, including those in Tables 1, 2, 3, and 4. Thus, as a specific example, the antigen binding proteins that are provided include those that compete with an antibody comprising:

(a) 1, 2, 3, 4, 5 or all 6 of the CDRs listed for an antigen binding protein listed in Tables 3A and 3B, and 4A and 4B, infra;

(b) a $V_H$ and a $V_L$ selected from $V_L1$-$V_L100$ and $V_H1$-$V_H94$ and listed for an antigen binding protein listed in Tables 2A and 2B; or (c) two light chains and two heavy chains as specified for an antigen binding protein listed in Tables 1A and 1B, infra.

Thus, in one embodiment, the present disclosure provides antigen binding proteins, including human antibodies, that competes for binding to a complex comprising β-Klotho and at least one of (i) FGFR1c, (ii) FGFR2c and (iii) FGFR3c with a reference antibody, wherein the reference antibody comprises a combination of light chain and heavy chain variable domain sequences selected from the group consisting of $V_L1$ with $V_H1$, $V_L2$ with $V_H1$, $V_L3$ with $V_H2$ or $V_H3$, $V_L4$ with $V_H4$, $V_L5$ with $V_H5$, $V_L6$ with $V_H6$, $V_L7$ with $V_H6$, $V_L8$ with $V_H7$ or $V_H8$, $V_L9$ with $V_H9$, $V_L10$ with $V_H9$, $V_L11$ with $V_H 10$, $V_L12$ with $V_H11$, $V_L13$ with $V_H12$, $V_L13$ with $V_H14$, $V_L14$ with $V_H13$, $V_L15$ with $V_H14$, $V_L16$ with $V_H15$, $V_L17$ with $V_H16$, $V_L18$ with $V_H17$, $V_L19$ with $V_H18$, $V_L20$ with $V_H19$, $V_L21$ with $V_H20$, $V_L22$ with $V_H21$, $V_L23$ with $V_H22$, $V_L24$ with $V_H23$, $V_L25$ with $V_H24$, $V_L26$ with $V_H25$, $V_L27$ with $V_H26$, $V_L28$ with $V_H27$, $V_L29$ with $V_H28$, $V_L30$ with $V_H29$, $V_L31$ with $V_H30$, $V_L32$ with $V_H31$, $V_L33$ with $V_H32$, $V_L34$ with $V_H33$, $V_L35$ with $V_H34$, $V_L36$ with $V_H35$, $V_L37$ with $V_H36$, $V_L38$ with $V_H37$, $V_L39$ with $V_H38$, $V_L40$ with $V_H39$, $V_L41$ with $V_H40$, $V_L42$ with $V_H41$, $V_L43$ with $V_H42$, $V_L44$ with $V_H43$, $V_L45$ with $V_H44$, $V_L46$ with $V_H45$, $V_L47$ with $V_H46$, $V_L48$ with $V_H47$, $V_L49$ with $V_H48$, $V_L50$ with $V_H49$, $V_L51$ with $V_H50$, 52 with $V_H51$, $V_L53$ with $V_H52$, $V_L54$ with $V_H53$, $V_L55$ with 54, and $V_L56$ with $V_H54$, $V_L57$ with $V_H54$, $V_L58$ with $V_H55$, $V_L59$ with $V_H56$, $V_L60$ with $V_H57$, $V_L61$ with $V_H58$, $V_L62$ with $V_H59$, $V_L63$ with $V_H60$, $V_L64$ with $V_H1$, $V_L65$ with $V_H62$, $V_L66$ with $V_H63$, $V_L67$ with $V_H64$, $V_L68$ with $V_H65$, $V_L69$ with $V_H66$, $V_L70$ with $V_H67$, $V_L71$ with $V_H68$, $V_L72$ with $V_H69$, $V_L73$ with $V_H70$, $V_L74$ with $V_H70$, and $V_L75$ with $V_H70$, $V_L76$ with $V_H71$, $V_L77$ with $V_H72$, $V_L78$ with $V_H73$, $V_L79$ with $V_H74$, $V_L80$ with $V_H75$, $V_L81$ with $V_H76$, $V_L82$ with $V_H77$, $V_L83$ with $V_H78$, $V_L84$ with $V_H79$, $V_L85$ with $V_H80$, $V_L86$ with $V_H81$, $V_L87$ with $V_H82$, $V_L88$ with $V_H86$, $V_L89$ with $V_H83$, $V_L90$ with $V_H84$, $V_L91$ with $V_H85$, $V_L 92$ with $V_H 87$, $V_L 93$ with $V_H 88$, $V_L 94$ with $V_H 88$, $V_L 95$ with $V_H 89$, $V_L 96$ with $V_H 90$, $V_L 97$ with $V_H 91$, $V_L 98$ with $V_H 92$, $V_L 99$ with $V_H 93$, and $V_L 100$ with $V_H 94$.

In another embodiment, the present disclosure provides antigen binding proteins, including human antibodies, that compete for binding to a complex comprising β-Klotho and at least one of (i) FGFR1c, (ii) FGFR2c and (iii) FGFR3c with a reference antibody, wherein the reference antibody is 63G8, 64A8, 67B4, 68D3, 64E6, 65E8, 65F11, 67G7, 63B6, 64D4, 65C3, 68D5, 63E6, 66F7, 64H5, 65G4, 67G10v1, 67G10v2, 66B4, 66G2, 68G5, 63F5, 66F6, 65C1, 64A7, 66D4, 65B1, 67A4, 65B4, 63A10, 65H11, 64C8, 65E3, 65D4, 65D1, 67G8, 65B7, 64A6, 65F9, 67F5, 64B10, 68C8, 67A5, 67C10, 64H6, 63F9, 67F6, 48H11, 52A8, 52F5, 49H12, 54A1, 55G9, 49C8, 52H1, 60G5.2, 49G3, 59A10, 48F8, 53B9, 56B4, 57E7, 57F11, 59C9, 58A5, 57A4, 57F9, 51G2, 56A7, 56E4, 54H10, 55D1, 48H3, 53C11, 59G10.3, 51C10.1, 59D10v1, 59D10v2, 60F9, 48B4, 52D6, 61G5, 59G10.2, 51A8, 53H5.2, 53F6, 56C11, 49A10, 48D4, 49G2, 50C12, 55G11, 52C1, 55E9, 60D7, 51C10.2, 55D3, 57B12, 52C5, 60G5.1, 55E4, 49B11, 50H10, 53C1, 56G1, 48F3, 48C9, 49A12, 51E2, 51E5, 53H5.3, 56G3.3, 55B10, 52B8, 55G5, 52H2, 56G3.2, 6E7, 57D9, 61H5, 48G4, 50G1, 58C2, 50D4, 50G5v1, 50G5v2, 51C1, 53C3.2, 54H10.3, 55A7, 55E6, 61E1, 53C3.1, 49H4, and 51E2.

In a further embodiment, an isolated antigen binding protein, such as a human antibody, is provided that binds to a complex comprising β-Klotho and at least one of (i) FGFR1c, (ii) FGFR2c and (iii) FGFR3c with substantially the same Kd as a reference antibody; initiates FGF21-like signaling in an in vitro ELK-Luciferase assay to the same degree as a reference antibody; lowers blood glucose; lowers serum lipid levels; and/or competes for binding with said reference antibody to a complex comprising β-Klotho and at least one of (i) FGFR1c, (ii) FGFR2c and (iii) FGFR3c, wherein the reference antibody is selected from the group consisting of 63G8, 64A8, 67B4, 68D3, 64E6, 65E8, 65F11, 67G7, 63B6, 64D4, 65C3, 68D5, 63E6, 66F7, 64H5, 65G4, 67G10v1, 67G10v2, 66B4, 66G2, 68G5, 63F5, 66F6, 65C1, 64A7, 66D4, 65B1, 67A4, 65B4, 63A10, 65H11, 64C8, 65E3, 65D4, 65D1, 67G8, 65B7, 64A6, 65F9, 67F5, 64B10, 68C8, 67A5, 67C10, 64H6, 63F9, 67F6, 48H11, 52A8, 52F8, 49H12, 54A1, 55G9, 49C8, 52H1, 60G5.2, 49G3, 59A10, 48F8, 53B9, 56B4, 57E7, 57F11, 59C9, 58A5, 57A4, 57F9, 51G2, 56A7, 56E4, 54H10, 55D1, 48H3, 53C11, 59G10.3, 51C10.1, 59D10v1, 59D10v2, 60F9, 48B4, 52D6, 61G5, 59G10.2, 51A8, 53H5.2, 53F6, 56C11, 49A10, 48D4, 49G2, 50C12, 55G11, 52C1, 55E9, 60D7, 51C10.2, 55D3, 57B12, 52C5, 60G5.1, 55E4, 49B11, 50H10, 53C1, 56G1, 48F3, 48C9, 49A12, 51E2, 51E5, 53H5.3, 56G3.3, 55B10, 52B8, 55G5, 52H2, 56G3.2, 6E7, 57D9, 61H5, 48G4, 50G1, 58C2, 50D4, 50G5v1, 50G5v2, 51C1, 53C3.2, 54H10.3, 55A7, 55E6, 61E1, 53C3.1, 49H4, and 51E2.

The ability to compete with an antibody can be determined using any suitable assay, such as those described herein, in which antigen binding proteins 63G8, 64A8, 67B4, 68D3, 64E6, 65E8, 65F11, 67G7, 63B6, 64D4, 65C3, 68D5, 63E6, 66F7, 64H5, 65G4, 67G10v1, 67G10v2, 66B4, 66G2, 68G5, 63F5, 66F6, 65C1, 64A7, 66D4, 65B1, 67A4, 65B4, 63A10, 65H11, 64C8, 65E3, 65D4, 65D1, 67G8, 65B7, 64A6, 65F9, 67F5, 64B10, 68C8, 67A5, 67C10, 64H6, 63F9, 67F6, 48H11, 52A8, 52F8, 49H12, 54A1, 55G9, 49C8, 52H1, 60G5.2, 49G3, 59A10, 48F8, 53B9, 56B4, 57E7, 57F11, 59C9, 58A5, 57A4, 57F9, 51G2, 56A7, 56E4, 54H10, 55D1, 48H3, 53C11, 59G10.3, 51C10.1, 59D10v1, 59D10v2, 60F9, 48B4, 52D6, 61G5, 59G10.2, 51A8, 53H5.2, 53F6, 56C11, 49A10, 48D4, 49G2, 50C12, 55G11, 52C1, 55E9, 60D7, 51C10.2, 55D3, 57B12, 52C5, 60G5.1, 55E4, 49B11, 50H10, 53C1, 56G1, 48F3, 48C9, 49A12, 51E2, 51E5, 53H5.3, 56G3.3, 55B10, 52B8, 55G5, 52H2, 56G3.2, 6E7, 57D9, 61H5, 48G4, 50G1, 58C2, 50D4, 50G5v1, 50G5v2, 51C1, 53C3.2, 54H10.3, 55A7, 55E6, 61E1, 53C3.1, 49H4, and 51E2 can be used as the reference antibody.

Monoclonal Antibodies

The antigen binding proteins that are provided include monoclonal antibodies that bind to a complex comprising β-Klotho and at least one of (i) FGFR1c, (ii) FGFR2c and (iii) FGFR3c, and induce FGF21-like signaling to various degrees. Monoclonal antibodies can be produced using any technique known in the art, e.g., by immortalizing spleen cells harvested from the transgenic animal after completion of the immunization schedule. The spleen cells can be immortalized using any technique known in the art, e.g., by fusing them with myeloma cells to produce hybridomas. Myeloma cells for use in hybridoma-producing fusion procedures preferably are non-antibody-producing, have high fusion efficiency, and enzyme deficiencies that render them incapable of growing in certain selective media which support the growth of only the desired fused cells (hybridomas). Examples of suitable cell lines for use in mouse fusions include Sp-20, P3-X63/Ag8, P3-X63-Ag8.653, NS1/1.Ag 4 1, Sp210-Ag14, FO, NSO/U, MPC-11, MPC11-X45-GTG 1.7 and S194/5XXO Bul; examples of cell lines used in rat fusions include R210.RCY3, Y3-Ag 1.2.3, IR983F and 4B210. Other cell lines useful for cell fusions are U-266, GM1500-GRG2, LICR-LON-HMy2 and UC729-6.

In some instances, a hybridoma cell line is produced by immunizing an animal (e.g., a transgenic animal having human immunoglobulin sequences) with an immunogen comprising (1) cell-bound receptor of CHO transfectants expressing full length human FGFR1c and β-Klotho at the cell surface, obtained by transfecting CHO cells with cDNA encoding a human full length FGFR1c polypeptide of SEQ ID NO: 4 and cDNA encoding a human β-Klotho polypeptide of SEQ ID NO: 7 with cells incubated with FGF21 prior to freezing (as shown in Example 2); or (2) cell-bound receptor of 293T transfectants expressing full length human (3-Klotho and an N-terminal truncated form of human FGFR1c encompassing amino acid residue #141 to #822 polypeptide of SEQ ID NO: 4 (as shown in Example 2); harvesting spleen cells from the immunized animal; fusing the harvested spleen cells to a myeloma cell line, thereby generating hybridoma cells; establishing hybridoma cell lines from the hybridoma cells, and identifying a hybridoma cell line that produces an antibody that binds to a complex comprising β-Klotho and at least one of (i) FGFR1c, (ii) FGFR2c and (iii) FGFR3c and can induce FGF21-like signaling (e.g., as described in Example 4). Such hybridoma cell lines, and the monoclonal antibodies produced by them, form aspects of the present disclosure.

Monoclonal antibodies secreted by a hybridoma cell line can be purified using any technique known in the art. Hybridomas or mAbs can be further screened to identify mAbs with particular properties, such as the ability to induce FGF21-like signaling. Examples of such screens are provided herein.

Chimeric and Humanized Antibodies

Chimeric and humanized antibodies based upon the foregoing sequences can readily be generated. One example is a chimeric antibody, which is an antibody composed of protein segments from different antibodies that are covalently joined to produce functional immunoglobulin light or heavy chains or immunologically functional portions thereof. Generally, a portion of the heavy chain and/or light chain is identical with or homologous to a corresponding sequence in antibodies derived from a particular species or belonging to a particular antibody class or subclass, while the remainder of the chain(s) is/are identical with or homologous to a corresponding sequence in antibodies derived from another species or belonging to another antibody class or subclass. For methods relating to chimeric antibodies, see, for example, U.S. Pat. No. 4,816,567; and Morrison et al., (1985) *Proc. Natl. Acad. Sci. USA* 81:6851-6855, which are hereby incorporated by reference. CDR grafting is described, for example, in U.S. Pat. No. 6,180,370, U.S. Pat. No. 5,693,762, U.S. Pat. No. 5,693,761, U.S. Pat. No. 5,585,089, and U.S. Pat. No. 5,530,101.

Generally, a goal of making a chimeric antibody is to create a chimera in which the number of amino acids from the intended patient/recipient species is maximized. One example is the "CDR-grafted" antibody, in which the antibody comprises one or more complementarity determining regions (CDRs) from a particular species or belonging to a particular antibody class or subclass, while the remainder of the antibody chain(s) is/are identical with or homologous to a corresponding sequence in antibodies derived from another species or belonging to another antibody class or subclass. For use in humans, the variable region or selected CDRs from a rodent antibody often are grafted into a human antibody, replacing the naturally-occurring variable regions or CDRs of the human antibody.

One useful type of chimeric antibody is a "humanized" antibody. Generally, a humanized antibody is produced from a monoclonal antibody raised initially in a non-human animal. Certain amino acid residues in this monoclonal antibody, typically from non-antigen recognizing portions of the antibody, are modified to be homologous to corresponding residues in a human antibody of corresponding isotype. Humanization can be performed, for example, using various methods by substituting at least a portion of a rodent variable region for the corresponding regions of a human antibody (see, e.g., U.S. Pat. No. 5,585,089, and No. 5,693,762; Jones et al., (1986) *Nature* 321:522-525; Riechmann et al., (1988) *Nature* 332:323-27; Verhoeyen et al., (1988) *Science* 239: 1534-1536).

In one aspect, the CDRs of the light and heavy chain variable regions of the antibodies provided herein (e.g., in Tables 3-4 and 21-23) are grafted to framework regions (FRs) from antibodies from the same, or a different, phylogenetic species. For example, the CDRs of the heavy and light chain variable regions $V_H1$, $V_H2$, $V_H3$, $V_H4$, $V_H5$, $V_H6$, $V_H7$, $V_H8$, $V_H9$, $V_H10$, $V_H11$, $V_H12$, $V_H13$, $V_H14$, $V_H15$, $V_H16$, $V_H17$, $V_H18$, $V_H19$, $V_H20$, $V_H21$ $V_H22$, $V_H23$, $V_H24$, $V_H25$, $V_H26$, $V_H27$, $V_H28$, $V_H29$, $V_H30$, $V_H31$, $V_H32$, $V_H33$, $V_H34$, $V_H35$, $V_H36$, $V_H37$, $V_H38$, $V_H39$, $V_H40$, $V_H41$, $V_H42$, $V_H43$, $V_H44$, $V_H45$, $V_H46$, $V_H47$, $V_H48$, $V_H49$, $V_H50$, $V_H51$, $V_H52$, $V_H53$, $V_H54$, $V_H55$, $V_H56$, $V_H57$, $V_H58$, $V_H59$, $V_H60$, $V_H61$, $V_H62$, $V_H63$, $V_H64$, $V_H65$, $V_H66$, $V_H67$, $V_H68$, $V_H69$, $V_H70$, $V_H71$, $V_H72$, $V_H73$, $V_H74$, $V_H75$, $V_H76$, $V_H77$, $V_H78$, $V_H79$, $V_H80$, 81, $V_H82$, $V_H83$, $V_H84$, $V_H85$, $V_H86$, $V_H87$, $V_H88$, $V_H89$, $V_H90$, $V_H91$, $V_H92$, $V_H93$, and $V_H94$ and/or $V_L1$, $V_L2$, $V_L3$, $V_L4$, $V_L5$, $V_L6$, $V_L7$, $V_L8$, $V_L9$, $V_L10$, $V_L11$, $V_L12$, $V_L13$, $V_L14$, $V_L15$, $V_L16$, $V_L17$, $V_L18$, $V_L19$, $V_L20$, $V_L21$, $V_L22$, $V_L23$, $V_L24$, $V_L25$, $V_L26$, $V_L27$, $V_L28$, $V_L29$, $V_L30$, $V_L31$, $V_L32$, $V_L33$, $V_L34$, $V_L35$, $V_L36$, $V_L37$, $V_L38$, $V_L39$, $V_L40$, $V_L41$, $V_L42$, $V_L43$, $V_L44$, $V_L45$, $V_L46$, $V_L47$, $V_L48$, $V_L49$, $V_L50$, $V_L51$, $V_L52$, $V_L53$, $V_L54$, $V_L55$, $V_L56$, $V_L57$, $V_L58$, $V_L59$, $V_L60$, $V_L61$, $V_L62$, $V_L63$, $V_L64$, $V_L65$, $V_L66$, $V_L67$, $V_L68$, $V_L69$, $V_L70$, $V_L71$, $V_L72$, $V_L73$, $V_L74$, $V_L75$, $V_L76$, $V_L77$, $V_L78$, $V_L79$, $V_L80$, $V_L81$, $V_L82$, $V_L83$, $V_L84$, $V_L85$, $V_L86$, $V_L87$, $V_L88$, $V_L89$, $V_L90$, $V_L91$, $V_L92$, $V_L93$, $V_L94$, $V_L95$, $V_L96$, $V_L97$, $V_L98$, $V_L99$ and $V_L100$ can be grafted to consensus human FRs. To create consensus human FRs, FRs from several human heavy chain or light chain amino acid sequences can be aligned to identify a consensus amino acid sequence. In other embodiments, the FRs of a heavy chain or light chain disclosed herein are replaced with the FRs from a different heavy chain or light chain. In one aspect, rare amino acids in the FRs of the heavy and light chains of an antigen binding protein (e.g., an antibody) that specifically binds to a complex comprising β-Klotho and at least one of (i) FGFR1c, (ii) FGFR2c and (iii) FGFR3c are not replaced, while the rest of the FR amino acids are replaced. A "rare amino acid" is a specific amino acid that is in a position in which this particular amino acid is not usually found in an FR. Alternatively, the grafted variable regions from the one heavy or light chain can be used with a constant region that is different from the constant region of that particular heavy or light chain as disclosed herein. In other embodiments, the grafted variable regions are part of a single chain Fv antibody.

In certain embodiments, constant regions from species other than human can be used along with the human variable region(s) to produce hybrid antibodies.

Fully Human Antibodies

Fully human antibodies are provided by the instant disclosure. Methods are available for making fully human antibodies specific for a given antigen without exposing human beings to the antigen ("fully human antibodies"). One specific means provided for implementing the production of fully human antibodies is the "humanization" of the mouse humoral immune system. Introduction of human immunoglobulin (Ig) loci into mice in which the endogenous Ig genes have been inactivated is one means of producing fully human monoclonal antibodies (mAbs) in mouse, an animal that can be immunized with any desirable antigen. Using fully human antibodies can minimize the immunogenic and allergic responses that can sometimes be caused by administering mouse or mouse-derived mAbs to humans as therapeutic agents.

Fully human antibodies can be produced by immunizing transgenic animals (typically mice) that are capable of producing a repertoire of human antibodies in the absence of endogenous immunoglobulin production. Antigens for this purpose typically have six or more contiguous amino acids, and optionally are conjugated to a carrier, such as a hapten. See, e.g., Jakobovits et al., (1993) *Proc. Natl. Acad. Sci. USA* 90:2551-2555; Jakobovits et al., (1993) *Nature* 362:255-258; and Bruggermann et al., (1993) *Year in Immunol.* 7:33. In one example of such a method, transgenic animals are produced by incapacitating the endogenous mouse immunoglobulin loci encoding the mouse heavy and light immunoglobulin chains therein, and inserting into the mouse genome large fragments of human genome DNA containing loci that encode human heavy and light chain proteins. Partially modified animals, which have less than the full complement of human immunoglobulin loci, are then cross-bred to obtain an animal having all of the desired immune system modifications. When administered an immunogen, these transgenic animals produce antibodies that are immunospecific for the immunogen but have human rather than murine amino acid sequences, including the variable regions. For further details of such methods, see, e.g., WO96/33735 and WO94/02602. Additional methods relating to transgenic mice for making human antibodies are described in U.S. Pat. No. 5,545,807; U.S. Pat. No. 6,713,610; U.S. Pat. No. 6,673,986; U.S. Pat. No. 6,162,963; U.S. Pat. No. 5,545,807; U.S. Pat. No. 6,300,129; U.S. Pat. No. 6,255,458; U.S. Pat. No. 5,877,397; U.S. Pat. No. 5,874,299 and U.S. Pat. No. 5,545,806; in PCT publications WO91/10741, WO90/04036, and in EP 546073 and EP 546073.

According to certain embodiments, antibodies of the invention can be prepared through the utilization of a transgenic mouse that has a substantial portion of the human antibody producing genome inserted but that is rendered deficient in the production of endogenous, murine antibodies. Such mice, then, are capable of producing human immunoglobulin molecules and antibodies and are deficient in the production of murine immunoglobulin molecules and antibodies. Technologies utilized for achieving this result are disclosed in the patents, applications and references disclosed in the specification, herein. In certain embodiments, one can employ methods such as those disclosed in PCT Published Application No. WO 98/24893 or in Mendez et al., (1997) *Nature Genetics,* 15:146-156, which are hereby incorporated by reference for any purpose.

Generally, fully human monoclonal antibodies specific for a complex comprising β-Klotho and at least one of (i) FGFR1c, (ii) FGFR2c and (iii) FGFR1c can be produced as follows. Transgenic mice containing human immunoglobulin genes are immunized with the antigen of interest, e.g. those described herein, lymphatic cells (such as B-cells) from the mice that express antibodies are obtained. Such recovered cells are fused with a myeloid-type cell line to prepare immortal hybridoma cell lines, and such hybridoma cell lines are screened and selected to identify hybridoma cell lines that produce antibodies specific to the antigen of interest. In certain embodiments, the production of a hybridoma cell line that produces antibodies specific to a complex comprising β-Klotho and at least one of (i) FGFR1c, (ii) FGFR2c and (iii) FGFR1c is provided.

In certain embodiments, fully human antibodies can be produced by exposing human splenocytes (B or T cells) to an antigen in vitro, and then reconstituting the exposed cells in an immunocompromised mouse, e.g. SCID or nod/SCID. See, e.g., Brams et al., J. Immunol. 160: 2051-2058 (1998); Carballido et al., Nat. Med., 6: 103-106 (2000). In certain such approaches, engraftment of human fetal tissue into SCID mice (SCID-hu) results in long-term hematopoiesis and human T-cell development. See, e.g., McCune et al., Science, 241:1532-1639 (1988); Ifversen et al., Sem. Immunol., 8:243-248 (1996). In certain instances, humoral immune response in such chimeric mice is dependent on co-development of human T-cells in the animals. See, e.g., Martensson et al., Immunol., 83:1271-179 (1994). In certain approaches, human peripheral blood lymphocytes are transplanted into SCID mice. See, e.g., Mosier et al., Nature, 335:256-259 (1988). In certain such embodiments, when such transplanted cells are treated either with a priming agent, such as Staphylococcal Enterotoxin A (SEA), or with anti-human CD40 monoclonal antibodies, higher levels of B cell production is detected. See, e.g., Martensson et al., Immunol., 84: 224-230 (1995); Murphy et al., Blood, 86:1946-1953 (1995).

Thus, in certain embodiments, fully human antibodies can be produced by the expression of recombinant DNA in host cells or by expression in hybridoma cells. In other embodiments, antibodies can be produced using the phage display techniques described herein.

The antibodies described herein were prepared through the utilization of the XENOMOUSE® technology, as described herein. Such mice, then, are capable of producing human immunoglobulin molecules and antibodies and are deficient in the production of murine immunoglobulin molecules and antibodies. Technologies utilized for achieving the same are disclosed in the patents, applications, and references disclosed in the background section herein. In particular, however, a preferred embodiment of transgenic production of mice and antibodies therefrom is disclosed in U.S. patent application Ser. No. 08/759,620, filed Dec. 3, 1996 and International Patent Application Nos. WO 98/24893, published Jun. 11, 1998 and WO 00/76310, published Dec. 21, 2000, the disclosures of which are hereby incorporated by reference. See also Mendez et al., Nature Genetics, 15:146-156 (1997), the disclosure of which is hereby incorporated by reference.

Through the use of such technology, fully human monoclonal antibodies to a variety of antigens have been produced. Essentially, XENOMOUSE® lines of mice are immunized with an antigen of interest (e.g. an antigen provided herein), lymphatic cells (such as B-cells) are recovered from the hyper-immunized mice, and the recovered lymphocytes are fused with a myeloid-type cell line to prepare immortal hybridoma cell lines. These hybridoma cell lines are screened and selected to identify hybridoma cell lines that produced antibodies specific to the antigen of interest. Provided herein are methods for the production of multiple hybridoma cell lines that produce antibodies specific to a complex comprising β-Klotho and at least one of (i) FGFR1c, (ii) FGFR2c and (iii) FGFR1c. Further, provided herein are characterization of the antibodies produced by such cell lines, including nucleotide and amino acid sequence analyses of the heavy and light chains of such antibodies.

The production of the XENOMOUSE® strains of mice is further discussed and delineated in U.S. patent application Ser. No. 07/466,008, filed Jan. 12, 1990, Ser. No. 07/610, 515, filed Nov. 8, 1990, Ser. No. 07/919,297, filed Jul. 24, 1992, Ser. No. 07/922,649, filed Jul. 30, 1992, Ser. No. 08/031,801, filed Mar. 15, 1993, Ser. No. 08/112,848, filed Aug. 27, 1993, Ser. No. 08/234,145, filed Apr. 28, 1994, Ser. No. 08/376,279, filed Jan. 20, 1995, Ser. No. 08/430,938, filed Apr. 27, 1995, Ser. No. 08/464,584, filed Jun. 5, 1995, Ser. No. 08/464,582, filed Jun. 5, 1995, Ser. No. 08/463,191, filed Jun. 5, 1995, Ser. No. 08/462,837, filed Jun. 5, 1995, Ser. No. 08/486,853, filed Jun. 5, 1995, Ser. No. 08/486,857, filed Jun. 5, 1995, Ser. No. 08/486,859, filed Jun. 5, 1995, Ser. No. 08/462,513, filed Jun. 5, 1995, Ser. No. 08/724,752, filed Oct. 2, 1996, Ser. No. 08/759,620, filed Dec. 3, 1996, U.S. Publication 2003/0093820, filed Nov. 30, 2001 and U.S. Pat. Nos. 6,162,963, 6,150,584, 6,114,598, 6,075,181, and 5,939,598 and Japanese Patent Nos. 3 068 180 B2, 3 068 506 B2, and 3 068 507 B2. See also European Patent No., EP 0 463 151 B1, grant published Jun. 12, 1996, International Patent Application No., WO 94/02602, published Feb. 3, 1994, International Patent Application No., WO 96/34096, published Oct. 31, 1996, WO 98/24893, published Jun. 11, 1998, WO 00/76310, published Dec. 21, 2000. The disclosures of each of the above-cited patents, applications, and references are hereby incorporated by reference in their entirety.

Using hybridoma technology, antigen-specific human mAbs with the desired specificity can be produced and selected from the transgenic mice such as those described herein. Such antibodies can be cloned and expressed using a suitable vector and host cell, or the antibodies can be harvested from cultured hybridoma cells.

Fully human antibodies can also be derived from phage-display libraries (as described in Hoogenboom et al., (1991) J. Mol. Biol. 227:381; and Marks et al., (1991) J. Mol. Biol. 222:581). Phage display techniques mimic immune selection through the display of antibody repertoires on the surface of filamentous bacteriophage, and subsequent selection of phage by their binding to an antigen of choice. One such technique is described in PCT Publication No. WO 99/10494 (hereby incorporated by reference), which describes the isolation of high affinity and functional agonistic antibodies for MPL- and msk-receptors using such an approach.

Bispecific or Bifunctional Antigen Binding Proteins

Also provided are bispecific and bifunctional antibodies that include one or more CDRs or one or more variable regions as described above. A bispecific or bifunctional antibody in some instances can be an artificial hybrid antibody having two different heavy/light chain pairs and two different binding sites. Bispecific antibodies can be produced by a variety of methods including, but not limited to, fusion of hybridomas or linking of Fab' fragments. See, e.g., Songsivilai & Lachmann, (1990) Clin. Exp. Immunol. 79:315-321; Kostelny et al., (1992) J. Immunol. 148:1547-1553. When an antigen binding protein of the instant disclosure binds to a complex comprising β-Klotho and at least one of (i) FGFR1c, (ii) FGFR2c and (iii) FGFR3c, the binding may lead to the activation of FGF21-like activity as measured by the FGF21-like functional and signaling assays described in Examples 4-6; when such an antigen binding protein is an antibody it is referred to as an agonistic antibody.

Various Other Forms

Some of the antigen binding proteins that specifically bind to a complex comprising β-Klotho and at least one of (i) FGFR1c, (ii) FGFR2c and (iii) FGFR3c that are provided in the present disclosure include variant forms of the antigen binding proteins disclosed herein (e.g., those having the sequences listed in Tables 1-4 and 6-23).

In various embodiments, the antigen binding proteins disclosed herein can comprise one or more non-naturally occurring/encoded amino acids. For instance, some of the antigen binding proteins have one or more non-naturally occurring/encoded amino acid substitutions in one or more of the heavy or light chains, variable regions or CDRs listed in Tables 1-23. Examples of non-naturally occurring/encoded amino acids (which can be substituted for any naturally-occurring amino acid found in any sequence disclosed herein, as desired) include: 4-hydroxyproline, γ-carboxyglutamate, ε-N,N,N-trimethyllysine, ε-N-acetyllysine, O-phosphoserine, N-acetylserine, N-formylmethionine, 3-methylhistidine, 5-hydroxylysine, α-N-methylarginine, and other similar amino acids and imino acids (e.g., 4-hydroxyproline). In the polypeptide notation used herein, the left-hand direction is the amino terminal direction and the right-hand direction is the carboxyl-terminal direction, in accordance with standard usage and convention. A non-limiting lists of examples of non-naturally occurring/encoded amino acids that can be inserted into an antigen binding protein sequence or substituted for a wild-type residue in an antigen binding sequence include β-amino acids, homoamino acids, cyclic amino acids and amino acids with derivatized side chains. Examples include (in the L-form or D-form; abbreviated as in parentheses): citrulline (Cit), homocitrulline (hCit), Nα-methylcitrulline (NMeCit), Nα-methylhomocitrulline (Nα-MeHoCit), ornithine (Orn), Nα-Methylornithine (Nα-MeOrn or NMeOrn), sarcosine (Sar), homolysine (hLys or hK), homoarginine (hArg or hR), homoglutamine (hQ), Nα-methylarginine (NMeR), Nα-methylleucine (Nα-MeL or NMeL), N-methylhomolysine (NMeHoK), Nα-methylglutamine (NMeQ), norleucine (Nle), norvaline (Nva), 1,2,3,4-tetrahydroisoquinoline (Tic), Octahydroindole-2-carboxylic acid (Oic), 3-(1-naphthyl)alanine (1-Nal), 3-(2-naphthyl)alanine (2-Nal), 1,2,3,4-tetrahydroisoquinoline (Tic), 2-indanylglycine (IgI), para-iodophenylalanine (pI-Phe), para-aminophenylalanine (4AmP or 4-Amino-Phe), 4-guanidino phenylalanine (Guf), glycyllysine (abbreviated "K(Nε-glycyl)" or "K(glycyl)" or "K(gly)"), nitrophenylalanine (nitrophe), aminophenylalanine (aminophe or Amino-Phe), benzylphenylalanine (benzylphe), γ-carboxyglutamic acid (γ-carboxyglu), hydroxyproline (hydroxypro), p-carboxyl-phenylalanine (Cpa), α-aminoadipic acid (Aad), Nα-methyl valine (NMeVal), N-α-methyl leucine (NMeLeu), Nα-methylnorleucine (NMeNle), cyclopentylglycine (Cpg), cyclohexylglycine (Chg), acetylarginine (acetylarg), α,β-diaminopropionoic acid (Dpr), α,γ-diaminobutyric acid (Dab), diaminopropionic acid (Dap), cyclohexylalanine (Cha), 4-methyl-phenylalanine (MePhe), β,β-diphenyl-alanine (BiPhA), aminobutyric acid (Abu), 4-phenyl-phenylalanine (or biphenylalanine; 4Bip), α-amino-isobutyric acid (Aib), beta-alanine, beta-aminopropionic acid, piperidinic acid, aminocaprioic acid, aminoheptanoic acid, aminopimelic acid, desmosine, diaminopimelic acid, N-ethylglycine, N-ethylaspargine, hydroxylysine, allo-hydroxylysine, isodesmosine, allo-isoleucine, N-methylglycine, N-methylisoleucine, N-methylvaline, 4-hydroxyproline (Hyp), γ-carboxyglutamate, ε-N,N,N-trimethyllysine, ε-N-acetyllysine, O-phosphoserine, N-acetylserine, N-formylmethionine, 3-methylhistidine, 5-hydroxylysine, ω-methylarginine, 4-Amino-O-Phthalic Acid (4APA), and other similar amino acids, and derivatized forms of any of those specifically listed.

Additionally, the antigen binding proteins can have one or more conservative amino acid substitutions in one or more of the heavy or light chains, variable regions or CDRs listed in Tables 1-4 and 6-23. Naturally-occurring amino acids can be divided into classes based on common side chain properties:
1) hydrophobic: norleucine, Met, Ala, Val, Leu, Ile;
2) neutral hydrophilic: Cys, Ser, Thr, Asn, Gln;
3) acidic: Asp, Glu;
4) basic: His, Lys, Arg;
5) residues that influence chain orientation: Gly, Pro; and
6) aromatic: Trp, Tyr, Phe.

Conservative amino acid substitutions can involve exchange of a member of one of these classes with another member of the same class. Conservative amino acid substitutions can encompass non-naturally occurring/encoded amino acid residues, which are typically incorporated by chemical peptide synthesis rather than by synthesis in biological systems. See Table 8, infra. These include peptidomimetics and other reversed or inverted forms of amino acid moieties.

Non-conservative substitutions can involve the exchange of a member of one of the above classes for a member from another class. Such substituted residues can be introduced into regions of the antibody that are homologous with human antibodies, or into the non-homologous regions of the molecule.

In making such changes, according to certain embodiments, the hydropathic index of amino acids can be considered. The hydropathic profile of a protein is calculated by assigning each amino acid a numerical value ("hydropathy index") and then repetitively averaging these values along the peptide chain. Each amino acid has been assigned a hydropathic index on the basis of its hydrophobicity and charge characteristics. They are: isoleucine (+4.5); valine (+4.2); leucine (+3.8); phenylalanine (+2.8); cysteine/cystine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9); and arginine (−4.5).

The importance of the hydropathic profile in conferring interactive biological function on a protein is understood in the art (see, e.g., Kyte et al., 1982, *J. Mol. Biol.* 157:105-131). It is known that certain amino acids can be substituted for other amino acids having a similar hydropathic index or score and still retain a similar biological activity. In making changes based upon the hydropathic index, in certain embodiments, the substitution of amino acids whose hydropathic indices are within ±2 is included. In some aspects, those which are within ±1 are included, and in other aspects, those within ±0.5 are included.

It is also understood in the art that the substitution of like amino acids can be made effectively on the basis of hydrophilicity, particularly where the biologically functional protein or peptide thereby created is intended for use in immunological embodiments, as in the present case. In certain embodiments, the greatest local average hydrophilicity of a protein, as governed by the hydrophilicity of its adjacent amino acids, correlates with its immunogenicity and antigen-binding or immunogenicity, that is, with a biological property of the protein.

The following hydrophilicity values have been assigned to these amino acid residues: arginine (+3.0); lysine (+3.0); aspartate (+3.0±1); glutamate (+3.0±1); serine (+0.3); asparagine (+0.2); glutamine (+0.2); glycine (0); threonine (−0.4); proline (−0.5±1); alanine (−0.5); histidine (−0.5); cysteine (−1.0); methionine (−1.3); valine (−1.5); leucine (−1.8); isoleucine (−1.8); tyrosine (−2.3); phenylalanine (−2.5) and tryptophan (−3.4). In making changes based upon similar hydrophilicity values, in certain embodiments, the substitution of amino acids whose hydrophilicity values are within ±2 is included, in other embodiments, those which are within ±1 are included, and in still other embodiments, those within ±0.5 are included. In some instances, one can also identify epitopes from primary amino acid sequences on the basis of hydrophilicity. These regions are also referred to as "epitopic core regions."

Exemplary conservative amino acid substitutions are set forth in Table 8.

TABLE 8

Conservative Amino Acid Substitutions

| Original Residue | Exemplary Substitutions |
|---|---|
| Ala | Ser |
| Arg | Lys |
| Asn | Gln, His |
| Asp | Glu |
| Cys | Ser |
| Gln | Asn |
| Glu | Asp |
| Gly | Pro |
| His | Asn, Gln |
| Ile | Leu, Val |
| Leu | Ile, Val |
| Lys | Arg, Gln, Glu |
| Met | Leu, Ile |
| Phe | Met, Leu, Tyr |
| Ser | Thr |
| Thr | Ser |
| Trp | Tyr |
| Tyr | Trp, Phe |
| Val | Ile, Leu |

A skilled artisan will be able to determine suitable variants of polypeptides as set forth herein using well-known techniques coupled with the information provided herein. One skilled in the art can identify suitable areas of the molecule that can be changed without destroying activity by targeting regions not believed to be important for activity. The skilled artisan also will be able to identify residues and portions of the molecules that are conserved among similar polypeptides. In further embodiments, even areas that can be important for biological activity or for structure can be subject to conservative amino acid substitutions without destroying the biological activity or without adversely affecting the polypeptide structure.

Additionally, one skilled in the art can review structure-function studies identifying residues in similar polypeptides that are important for activity or structure. In view of such a comparison, one can predict the importance of amino acid residues in a protein that correspond to amino acid residues important for activity or structure in similar proteins. One skilled in the art can opt for chemically similar amino acid substitutions for such predicted important amino acid residues.

One skilled in the art can also analyze the three-dimensional structure and amino acid sequence in relation to that structure in similar polypeptides. In view of such information, one skilled in the art can predict the alignment of amino acid residues of an antibody with respect to its three dimensional structure. One skilled in the art can choose not to make radical changes to amino acid residues predicted to be on the surface of the protein, since such residues can be involved in important interactions with other molecules. Moreover, one skilled in the art can generate test variants containing a single amino acid substitution at each desired amino acid residue. These variants can then be screened using assays for FGF21-like signaling, (including those described in the Examples provided herein) thus yielding information regarding which amino acids can be changed and which must not be changed. In other words, based on information gathered from such routine experiments, one skilled in the art can readily determine the amino acid positions where further substitutions should be avoided either alone or in combination with other mutations.

A number of scientific publications have been devoted to the prediction of secondary structure. See, Moult, (1996) *Curr. Op. in Biotech.* 7:422-427; Chou et al., (1974) *Biochem.* 13:222-245; Chou et al., (1974) *Biochemistry* 113:211-222; Chou et al., (1978) *Adv. Enzymol. Relat. Areas Mol. Biol.* 47:45-148; Chou et al., (1979) *Ann. Rev. Biochem.* 47:251-276; and Chou et al., (1979) *Biophys. J.* 26:367-384. Moreover, computer programs are currently available to assist with predicting secondary structure. One method of predicting secondary structure is based upon homology modeling. For example, two polypeptides or proteins that have a sequence identity of greater than 30%, or similarity greater than 40% can have similar structural topologies. The growth of the protein structural database (PDB) has provided enhanced predictability of secondary structure, including the potential number of folds within a polypeptide's or protein's structure. See, Holm et al., (1999) *Nucl. Acid. Res.* 27:244-247. It has been suggested (Brenner et al., (1997) *Curr. Op. Struct. Biol.* 7:369-376) that there are a limited number of folds in a given polypeptide or protein and that once a critical number of structures have been resolved, structural prediction will become dramatically more accurate.

Additional methods of predicting secondary structure include "threading" (Jones, (1997) *Curr. Opin. Struct. Biol.* 7:377-387; Sippl et al., (1996) *Structure* 4:15-19), "profile analysis" (Bowie et al., (1991) *Science* 253:164-170; Gribskov et al., (1990) *Meth. Enzym.* 183:146-159; Gribskov et al., (1987) *Proc. Nat. Acad. Sci.* 84:4355-4358), and "evolutionary linkage" (See, Holm, (1999) supra; and Brenner, (1997) supra).

In some embodiments, amino acid substitutions are made that: (1) reduce susceptibility to proteolysis, (2) reduce susceptibility to oxidation, (3) alter binding affinity for forming protein complexes, (4) alter ligand or antigen binding affinities, and/or (4) confer or modify other physicochemical or functional properties on such polypeptides. For example, single or multiple amino acid substitutions (in some embodiments, conservative amino acid substitutions) can be made in the naturally-occurring sequence. Substitutions can be made in that portion of the antibody that lies outside the domain(s) forming intermolecular contacts. In such embodiments, conservative amino acid substitutions can be used that do not substantially change the structural characteristics of the parent sequence (e.g., one or more replacement amino acids that do not disrupt the secondary structure that characterizes the parent or native antigen binding protein). Examples of art-recognized polypeptide secondary and tertiary structures are described in Creighton, *Proteins: Structures and Molecular Properties* 2$^{nd}$ edition, 1992, W. H. Freeman & Company; Creighton, *Proteins: Structures and Molecular Principles*, 1984, W. H. Freeman & Company; *Introduction to Protein Structure* (Branden and Tooze, eds.), 2$^{nd}$ edition, 1999, Garland Publishing; Petsko & Ringe, *Protein Structure and Function*, 2004, New Science Press Ltd; and Thornton et al., (1991) *Nature* 354:105, which are each incorporated herein by reference.

Additional preferred antibody variants include cysteine variants wherein one or more cysteine residues in the parent or native amino acid sequence are deleted from or substituted with another amino acid (e.g., serine). Cysteine variants are useful, inter alia when antibodies must be refolded into a biologically active conformation. Cysteine variants can have fewer cysteine residues than the native antibody, and typically have an even number to minimize interactions resulting from unpaired cysteines.

The heavy and light chains, variable regions domains and CDRs that are disclosed can be used to prepare polypeptides that contain an antigen binding region that can specifically bind to a complex comprising β-Klotho and at least one of (i) FGFR1c, (ii) FGFR2c and (iii) FGFR3c and may induce FGF21-like signaling. For example, one or more of the CDRs listed in Tables 3-4 and 21-23 can be incorporated into a molecule (e.g., a polypeptide) covalently or noncovalently to make an immunoadhesion. An immunoadhesion can incorporate the CDR(s) as part of a larger polypeptide chain, can covalently link the CDR(s) to another polypeptide chain, or can incorporate the CDR(s) noncovalently. The CDR(s) enable the immunoadhesion to bind specifically to a particular antigen of interest (e.g., to a complex comprising β-Klotho and at least one of (i) FGFR1c, (ii) FGFR2c and (iii) FGFR3c or an epitope thereon).

The heavy and light chains, variable regions domains and CDRs that are disclosed can be used to prepare polypeptides that contain an antigen binding region that can specifically bind to a complex comprising β-Klotho and at least one of (i) FGFR1c, (ii) FGFR2c and (iii) FGFR3c and may induce FGF21-like signaling. For example, one or more of the CDRs listed in Tables 3-4 and 21-23 can be incorporated into a molecule (e.g., a polypeptide) that is structurally similar to a "half" antibody comprising the heavy chain, the light chain of an antigen binding protein paired with a Fc fragment so that the antigen binding region is monovalent (like a Fab fragment) but with a dimeric Fc moiety.

Mimetics (e.g., "peptide mimetics" or "peptidomimetics") based upon the variable region domains and CDRs that are described herein are also provided. These analogs can be peptides, non-peptides or combinations of peptide and non-peptide regions. Fauchere, (1986) *Adv. Drug Res.* 15:29; Veber and Freidinger, (1985) *TINS p.* 392; and Evans et al., (1987) *J. Med. Chem.* 30:1229, which are incorporated herein by reference for any purpose. Peptide mimetics that are structurally similar to therapeutically useful peptides can be used to produce a similar therapeutic or prophylactic effect. Such compounds are often developed with the aid of computerized molecular modeling. Generally, peptidomimetics are proteins that are structurally similar to an antibody displaying a desired biological activity, such as here the ability to specifically bind to a complex comprising β-Klotho and at least one of (i) FGFR1c, (ii) FGFR2c and (iii) FGFR3c, but have one or more peptide linkages optionally replaced by a linkage selected from: —CH$_2$NH—, —CH$_2$S—, —CH$_2$—CH$_2$—, —CH—CH-(cis and trans), —COCH$_2$—, —CH(OH)CH$_2$—, and —CH$_2$SO—, by methods well known in the art. Systematic substitution of one or more amino acids of a consensus sequence with a D-amino acid of the same type (e.g., D-lysine in place of L-lysine) can be used in certain embodiments to generate more stable proteins. In addition, constrained peptides comprising a consensus sequence or a substantially identical consensus sequence variation can be generated by methods known in the art (Rizo and Gierasch, (1992) *Ann. Rev. Biochem.* 61:387), incorporated herein by reference), for example, by adding internal cysteine residues capable of forming intramolecular disulfide bridges which cyclize the peptide.

Derivatives of the antigen binding proteins that specifically bind to a complex comprising β-Klotho and at least one of (i) FGFR1c, (ii) FGFR2c and (iii) FGFR3c that are described herein are also provided. The derivatized antigen binding proteins can comprise any molecule or substance that imparts a desired property to the antibody or fragment, such as increased half-life in a particular use. The derivatized antigen binding protein can comprise, for example, a detectable (or labeling) moiety (e.g., a radioactive, colorimetric, antigenic or enzymatic molecule, a detectable bead (such as a magnetic or electrodense (e.g., gold) bead), or a molecule that binds to another molecule (e.g., biotin or streptavidin), a therapeutic or diagnostic moiety (e.g., a radioactive, cytotoxic, or pharmaceutically active moiety), or a molecule that increases the suitability of the antigen binding protein for a particular use (e.g., administration to a subject, such as a human subject, or other in vivo or in vitro uses). Examples of molecules that can be used to derivatize an antigen binding protein include albumin (e.g., human serum albumin) and polyethylene glycol (PEG). Albumin-linked and PEGylated derivatives of antigen binding proteins can be prepared using techniques well known in the art. Certain antigen binding proteins include a PEGylated single chain polypeptide as described herein. In one embodiment, the antigen binding protein is conjugated or otherwise linked to transthyretin ("TTR") or a TTR variant. The TTR or TTR variant can be chemically modified with, for example, a chemical selected from the group consisting of dextran, poly(n-vinyl pyrrolidone), polyethylene glycols, propropylene glycol homopolymers, polypropylene oxide/ethylene oxide co-polymers, polyoxyethylated polyols and polyvinyl alcohols.

Other derivatives include covalent or aggregative conjugates of the antigen binding proteins that specifically bind to a complex comprising β-Klotho and at least one of (i) FGFR1c, (ii) FGFR2c and (iii) FGFR3c that are disclosed herein with other proteins or polypeptides, such as by expression of recombinant fusion proteins comprising heterologous polypeptides fused to the N-terminus or C-terminus of an antigen binding protein that induces FGF21-like signaling. For example, the conjugated peptide can be a heterologous signal (or leader) polypeptide, e.g., the yeast alpha-factor leader, or a peptide such as an epitope tag. An antigen binding protein-containing fusion protein of the present disclosure can comprise peptides added to facilitate purification or identification of an antigen binding protein that specifically binds to a complex comprising β-Klotho and at least one of (i) FGFR1c, (ii) FGFR2c and (iii) FGFR3c (e.g., a poly-His tag) and that can induce FGF21-like signaling. An antigen binding protein that specifically binds to a complex comprising β-Klotho and at least one of (i) FGFR1c, (ii) FGFR2c and (iii) FGFR3c also can be linked to the FLAG peptide as described in Hopp et al., (1988) *Bio/Technology* 6:1204; and U.S. Pat. No. 5,011,912. The FLAG peptide is highly antigenic and provides an epitope reversibly bound by a specific monoclonal antibody (mAb), enabling rapid assay and facile purification of expressed recombinant protein. Reagents useful for preparing fusion proteins in which the FLAG peptide is fused to a given polypeptide are commercially available (Sigma, St. Louis, Mo.).

Multimers that comprise one or more antigen binding proteins that specifically bind to a complex comprising β-Klotho and at least one of (i) FGFR1c, (ii) FGFR2c and (iii) FGFR3c form another aspect of the present disclosure. Multimers can take the form of covalently-linked or non-covalently-linked dimers, trimers, or higher multimers. Multimers comprising two or more antigen binding proteins that bind to a complex comprising β-Klotho and at least one of (i) FGFR1c, (ii) FGFR2c and (iii) FGFR3c and which may induce FGF21-like signaling are contemplated for use as therapeutics, diagnostics and for other uses as well, with one example of such a multimer being a homodimer. Other exemplary multimers include heterodimers, homotrimers, heterotrimers, homotetramers, heterotetramers, etc.

One embodiment is directed to multimers comprising multiple antigen binding proteins that specifically bind to a complex comprising β-Klotho and at least one of (i) FGFR1c, (ii) FGFR2c and (iii) FGFR3c joined via covalent or non-covalent interactions between peptide moieties fused to an antigen binding protein that specifically binds to a complex comprising β-Klotho and at least one of (i) FGFR1c, (ii) FGFR2c and (iii) FGFR3c. Such peptides can be peptide linkers (spacers), or peptides that have the property of promoting multimerization. Leucine zippers and certain polypeptides derived from antibodies are among the peptides that can promote multimerization of antigen binding proteins attached thereto, as described in more detail herein.

In particular embodiments, the multimers comprise from two to four antigen binding proteins that bind to a complex comprising β-Klotho and at least one of (i) FGFR1c, (ii) FGFR2c and (iii) FGFR3c. The antigen binding protein moieties of the multimer can be in any of the forms described above, e.g., variants or fragments. Preferably, the multimers comprise antigen binding proteins that have the ability to specifically bind to a complex comprising β-Klotho and at least one of (i) FGFR1c, (ii) FGFR2c and (iii) FGFR3c.

In one embodiment, an oligomer is prepared using polypeptides derived from immunoglobulins. Preparation of fusion proteins comprising certain heterologous polypeptides fused to various portions of antibody-derived polypeptides (including the Fc domain) has been described, e.g., by Ashkenazi et al., (1991) *Proc. Natl. Acad. Sci. USA* 88:10535; Byrn et al., (1990) *Nature* 344:677; and Hollenbaugh et al., (1992) *Current Protocols in Immunology*, Suppl. 4, pages 10.19.1-10.19.11.

One embodiment comprises a dimer comprising two fusion proteins created by fusing an antigen binding protein that specifically binds to a complex comprising β-Klotho and at least one of (i) FGFR1c, (ii) FGFR2c and (iii) FGFR3c to the Fc region of an antibody. The dimer can be made by, for example, inserting a gene fusion encoding the fusion protein into an appropriate expression vector, expressing the gene fusion in host cells transformed with the recombinant expression vector, and allowing the expressed fusion protein to assemble much like antibody molecules, whereupon interchain disulfide bonds form between the Fc moieties to yield the dimer.

The term "Fc polypeptide" as used herein includes native and mutein forms of polypeptides derived from the Fc region of an antibody. Truncated forms of such polypeptides containing the hinge region that promotes dimerization also are included. Fusion proteins comprising Fc moieties (and oligomers formed therefrom) offer the advantage of facile purification by affinity chromatography over Protein A or Protein G columns.

One suitable Fc polypeptide, described in PCT application WO 93/10151 and U.S. Pat. No. 5,426,048 and U.S. Pat. No. 5,262,522, is a single chain polypeptide extending from the N-terminal hinge region to the native C-terminus of the Fc region of a human IgG1 antibody. Another useful Fc polypeptide is the Fc mutein described in U.S. Pat. No. 5,457,035, and in Baum et al., (1994) *EMBO J.* 13:3992-4001. The amino acid sequence of this mutein is identical to that of the native Fc sequence presented in WO 93/10151, except that amino acid 19 has been changed from Leu to Ala, amino acid 20 has been changed from Leu to Glu, and amino acid 22 has been changed from Gly to Ala. The mutein exhibits reduced affinity for Fc receptors.

In other embodiments, the variable portion of the heavy and/or light chains of a antigen binding protein such as disclosed herein can be substituted for the variable portion of an antibody heavy and/or light chain.

Alternatively, the oligomer is a fusion protein comprising multiple antigen binding proteins that specifically bind to a complex comprising β-Klotho and at least one of (i) FGFR1c, (ii) FGFR2c and (iii) FGFR3c with or without peptide linkers (spacer peptides). Among the suitable peptide linkers are those described in U.S. Pat. No. 4,751,180 and U.S. Pat. No. 4,935,233.

Another method for preparing oligomeric derivatives comprising that antigen binding proteins that specifically bind to a complex comprising β-Klotho and at least one of (i) FGFR1c, (ii) FGFR2c and (iii) FGFR3c involves use of a leucine zipper. Leucine zipper domains are peptides that promote oligomerization of the proteins in which they are found. Leucine zippers were originally identified in several DNA-binding proteins (Landschultz et al., (1988) *Science* 240:1759-64), and have since been found in a variety of different proteins. Among the known leucine zippers are naturally occurring peptides and derivatives thereof that dimerize or trimerize. Examples of leucine zipper domains suitable for producing soluble oligomeric proteins are described in PCT application WO 94/10308, and the leucine zipper derived from lung surfactant protein D (SPD) described in Hoppe et al., (1994) *FEBS Letters* 344:191, hereby incorporated by reference. The use of a modified leucine zipper that allows for stable trimerization of a heterologous protein fused thereto is described in Fanslow et al., (1994) *Semin. Immunol.* 6:267-278. In one approach, recombinant fusion proteins comprising an antigen binding protein fragment or derivative that specifically binds to a complex comprising β-Klotho and an FGFR (e.g., FGFR1c, FGFR2c or FGFR3c) is fused to a leucine zipper peptide are expressed in suitable host cells, and the soluble oligomeric antigen binding protein fragments or derivatives that form are recovered from the culture supernatant.

In certain embodiments, the antigen binding protein has a $K_D$ (equilibrium binding affinity) of less than 1 μM, 10 μM, 100 μM, 1 nM, 2 nM, 5 nM, 10 nM, 25 nM or 50 nM.

In another aspect the instant disclosure provides an antigen binding protein having a half-life of at least one day in vitro or in vivo (e.g., when administered to a human subject). In one embodiment, the antigen binding protein has a half-life of at least three days. In another embodiment, the antibody or portion thereof has a half-life of four days or longer. In another embodiment, the antibody or portion thereof has a half-life of eight days or longer. In another embodiment, the antibody or portion thereof has a half-life of ten days or longer. In another embodiment, the antibody or portion thereof has a half-life of eleven days or longer. In another embodiment, the antibody or portion thereof has a half-life of fifteen days or longer. In another embodiment, the antibody or antigen-binding portion thereof is derivatized or modified such that it has a longer half-life as compared to the underivatized or unmodified antibody. In another embodiment, an antigen binding protein that specifically binds to a complex comprising β-Klotho and at least one of (i) FGFR1c, (ii) FGFR2c and (iii) FGFR3c contains point mutations to increase serum half life, such as described in WO 00/09560, published Feb. 24, 2000, incorporated by reference.

Glycosylation

An antigen binding protein that specifically binds to a complex comprising β-Klotho and at least one of (i) FGFR1c, (ii) FGFR2c and (iii) FGFR3c can have a glycosylation pattern that is different or altered from that found in the native species. As is known in the art, glycosylation patterns can depend on both the sequence of the protein (e.g., the presence or absence of particular glycosylation amino acid residues, discussed below), or the host cell or organism in which the protein is produced. Particular expression systems are discussed below.

Glycosylation of polypeptides is typically either N-linked or O-linked. N-linked refers to the attachment of the carbohydrate moiety to the side chain of an asparagine residue. The tri-peptide sequences asparagine-X-serine and asparagine-X-threonine, where X is any amino acid except proline, are the recognition sequences for enzymatic attachment of the carbohydrate moiety to the asparagine side chain. Thus, the presence of either of these tri-peptide sequences in a polypeptide creates a potential glycosylation site. O-linked glycosylation refers to the attachment of one of the sugars N-acetylgalactosamine, galactose, or xylose, to a hydroxyamino acid, most commonly serine or threonine, although 5-hydroxyproline or 5-hydroxylysine can also be used.

Addition of glycosylation sites to the antigen binding protein is conveniently accomplished by altering the amino acid sequence such that it contains one or more of the above-described tri-peptide sequences (for N-linked glycosylation sites). The alteration can also be made by the addition of, or substitution by, one or more serine or threonine residues to the starting sequence (for O-linked glycosylation sites). For ease, the antigen binding protein amino acid sequence can be altered through changes at the DNA level, particularly by mutating the DNA encoding the target polypeptide at preselected bases such that codons are generated that will translate into the desired amino acids.

Another means of increasing the number of carbohydrate moieties on the antigen binding protein is by chemical or enzymatic coupling of glycosides to the protein. These procedures are advantageous in that they do not require production of the protein in a host cell that has glycosylation capabilities for N- and O-linked glycosylation. Depending on the coupling mode used, the sugar(s) can be attached to (a) arginine and histidine; (b) free carboxyl groups; (c) free sulfhydryl groups such as those of cysteine; (d) free hydroxyl groups such as those of serine, threonine, or hydroxyproline; (e) aromatic residues such as those of phenylalanine, tyrosine, or tryptophan; or (f) the amide group of glutamine. These methods are described in WO 87/05330 and in Aplin & Wriston, (1981) *CRC Crit. Rev. Biochem.* 10:259-306.

Removal of carbohydrate moieties present on the starting antigen binding protein can be accomplished chemically or enzymatically. Chemical deglycosylation requires exposure of the protein to the compound trifluoromethanesulfonic acid, or an equivalent compound. This treatment results in the cleavage of most or all sugars except the linking sugar (N-acetylglucosamine or N-acetylgalactosamine), while leaving the polypeptide intact. Chemical deglycosylation is described by Hakimuddin et al., (1987) *Arch. Biochem. Biophys.* 259:52-57 and by Edge et al., (1981) *Anal. Biochem.* 118:131-37. Enzymatic cleavage of carbohydrate moieties on polypeptides can be achieved by the use of a variety of endo- and exo-glycosidases as described by Thotakura et al., (1987) *Meth. Enzymol.* 138:350-59. Glycosylation at potential glycosylation sites can be prevented by the use of the compound tunicamycin as described by Duskin et al., (1982) *J. Biol. Chem.* 257:3105-09. Tunicamycin blocks the formation of protein-N-glycoside linkages.

Hence, aspects of the present disclosure include glycosylation variants of antigen binding proteins that specifically bind to a complex comprising β-Klotho and at least one of (i) FGFR1c, (ii) FGFR2c and (iii) FGFR3c wherein the number and/or type of glycosylation site(s) has been altered compared to the amino acid sequences of the parent polypeptide. In certain embodiments, antibody protein variants comprise a greater or a lesser number of N-linked glycosylation sites than the native antibody. An N-linked glycosylation site is characterized by the sequence: Asn-X-Ser or Asn-X-Thr, wherein the amino acid residue designated as X can be any amino acid residue except proline. The substitution of amino acid residues to create this sequence provides a potential new site for the addition of an N-linked carbohydrate chain. Alternatively, substitutions that eliminate or alter this sequence will prevent addition of an N-linked carbohydrate chain present in the native polypeptide. For example, the glycosylation can be reduced by the deletion of an Asn or by substituting the Asn with a different amino acid. In other embodiments, one or more new N-linked sites are created. Antibodies typically have a N-linked glycosylation site in the Fc region.

Labels and Effector Groups

In some embodiments, an antigen binding protein that specifically binds to a complex comprising β-Klotho and at least one of (i) FGFR1c, (ii) FGFR2c and (iii) FGFR3c comprises one or more labels. The term "labeling group" or "label" means any detectable label. Examples of suitable labeling groups include, but are not limited to, the following: radioisotopes or radionuclides (e.g., $^3$H, $^{14}$C, $^{15}$N, $^{35}$S, $^{90}$Y, $^{99}$Tc, $^{111}$In, $^{125}$I, $^{131}$I) fluorescent groups (e.g., FITC, rhodamine, lanthanide phosphors), enzymatic groups (e.g., horseradish peroxidase, β-galactosidase, luciferase, alkaline phosphatase), chemiluminescent groups, biotinyl groups, or predetermined polypeptide epitopes recognized by a secondary reporter (e.g., leucine zipper pair sequences, binding sites for secondary antibodies, metal binding domains, epitope tags). In some embodiments, the labeling group is coupled to the antigen binding protein via spacer arms of various lengths to reduce potential steric hindrance. Various methods for labeling proteins are known in the art and can be used as is seen fit.

The term "effector group" means any group coupled to an antigen binding protein that specifically binds to a complex comprising β-Klotho and at least one of (i) FGFR1c, (ii) FGFR2c and (iii) FGFR3c and that acts as a cytotoxic agent. Examples for suitable effector groups are radioisotopes or radionuclides (e.g., $^3$H, $^{14}$C, $^{15}$N, $^{35}$S, $^{90}$Y, $^{99}$Tc, $^{111}$In, $^{125}$I, $^{131}$I). Other suitable groups include toxins, therapeutic groups, or chemotherapeutic groups. Examples of suitable groups include calicheamicin, auristatins, geldanamycin and cantansine. In some embodiments, the effector group is coupled to the antigen binding protein via spacer arms of various lengths to reduce potential steric hindrance.

In general, labels fall into a variety of classes, depending on the assay in which they are to be detected: a) isotopic labels, which can be radioactive or heavy isotopes; b) magnetic labels (e.g., magnetic particles); c) redox active moieties; d) optical dyes; enzymatic groups (e.g. horseradish peroxidase, β-galactosidase, luciferase, alkaline phosphatase); e) biotinylated groups; and f) predetermined polypeptide epitopes recognized by a secondary reporter (e.g., leucine zipper pair sequences, binding sites for secondary antibodies, metal binding domains, epitope tags, etc.). In some embodiments, the labeling group is coupled to the antigen binding protein via spacer arms of various lengths to reduce potential steric hindrance. Various methods for labeling proteins are known in the art.

Specific labels include optical dyes, including, but not limited to, chromophores, phosphors and fluorophores, with the latter being specific in many instances. Fluorophores can be either "small molecule" fluores, or proteinaceous fluores.

By "fluorescent label" is meant any molecule that can be detected via its inherent fluorescent properties. Suitable fluorescent labels include, but are not limited to, fluorescein, rhodamine, tetramethylrhodamine, eosin, erythrosin, coumarin, methyl-coumarins, pyrene, Malacite green, stilbene, Lucifer Yellow, Cascade Blue, Texas Red, IAEDANS, EDANS, BODIPY FL, LC Red 640, Cy 5, Cy 5.5, LC Red 705, Oregon green, the Alexa-Fluor dyes (Alexa Fluor 350, Alexa Fluor 430, Alexa Fluor 488, Alexa Fluor 546, Alexa Fluor 568, Alexa Fluor 594, Alexa Fluor 633, Alexa Fluor 647, Alexa Fluor 660, Alexa Fluor 680), Cascade Blue, Cascade Yellow and R-phycoerythrin (PE) (Molecular Probes, Eugene, Oreg.), FITC, Rhodamine, and Texas Red (Pierce, Rockford, Ill.), Cy5, Cy5.5, Cy7 (Amersham Life Science, Pittsburgh, Pa.). Suitable optical dyes, including fluorophores, are described in *Molecular Probes Handbook* by Richard P. Haugland and in subsequent editions, including *Molecular Probes Handbook, A Guide to Fluorescent Probes and Labeling Technologies,* 11$^{th}$ edition, Johnson and Spence (eds), hereby expressly incorporated by reference.

Suitable proteinaceous fluorescent labels also include, but are not limited to, green fluorescent protein, including a *Renilla, Ptilosarcus,* or *Aequorea* species of GFP (Chalfie et al., (1994) *Science* 263:802-805), eGFP (Clontech Labs., Inc., Genbank Accession Number U55762), blue fluorescent protein (BFP, Quantum Biotechnologies, Inc., Quebec, Canada; Stauber, (1998) *Biotechniques* 24:462-71; Heim et al., (1996) *Curr. Biol.* 6:178-82), enhanced yellow fluorescent protein (EYFP, Clontech Labs., Inc.), luciferase (Ichiki et al., (1993) *J. Immunol.* 150:5408-17), β-galactosidase (Nolan et al., (1988) *Proc. Natl. Acad. Sci. U.S.A.* 85:2603-07) and *Renilla* (WO92/15673, WO95/07463, WO98/14605, WO98/26277, WO99/49019, U.S. Pat. Nos. 5,292,658, 5,418,155, 5,683,888, 5,741,668, 5,777,079, 5,804,387, 5,874,304, 5,876,995 and 5,925,558).

Preparing of Antigen Binding Proteins

Non-human antibodies that are provided can be, for example, derived from any antibody-producing animal, such as a mouse, rat, rabbit, goat, donkey, or non-human primate (such as a monkey, (e.g., cynomolgus or rhesus monkey) or an ape (e.g., chimpanzee)). Non-human antibodies can be used, for instance, in in vitro cell culture and cell-culture based applications, or any other application where an immune response to the antibody does not occur or is insignificant, can be prevented, is not a concern, or is desired. In certain embodiments, the antibodies can be produced by immunizing with cell bound receptor from CHO transfectants expressing full length human FGFR1c and β-Klotho at the cell surface following incubated with FGF21; or with cell bound receptor of 293T transfectants expressing full length human β-Klotho and an N-terminal truncated version of human FGFR1c encompassing amino acid residues 141 to 822 of the polypeptide of SEQ ID NO: 4; or with full-length β-Klotho, FGFR1c, FGFR2c or FGFR3c; or with the extracellular domain of β-Klotho, FGFR1c, FGFR2c or FGFR3c; or with two of β-Klotho, FGFR1c, FGFR2c, and FGFR3c; or with whole cells expressing FGFR1c, β-Klotho or both FGFR1c and β-Klotho; or with membranes prepared from cells expressing FGFR1c, β-Klotho or both FGFR1c and β-Klotho; or with fusion proteins, e.g., Fc fusions comprising FGFR1c, β-Klotho or FGFR1c and β-Klotho (or extracellular domains thereof) fused to Fc, and other methods known in the art, e.g., as described in the Examples presented herein. Alternatively, the certain non-human antibodies can be raised by immunizing with amino acids which are segments of one or more of β-Klotho, FGFR1c, FGFR2c or FGFR3c that form part of the epitope to which certain antibodies provided herein bind. The antibodies can be polyclonal, monoclonal, or can be synthesized in host cells by expressing recombinant DNA.

Fully human antibodies can be prepared as described above by immunizing transgenic animals containing human immunoglobulin loci or by selecting a phage display library that is expressing a repertoire of human antibodies.

The monoclonal antibodies (mAbs) can be produced by a variety of techniques, including conventional monoclonal antibody methodology, e.g., the standard somatic cell hybridization technique of Kohler & Milstein, (1975) *Nature* 256:495-97. Alternatively, other techniques for producing monoclonal antibodies can be employed, for example, the viral or oncogenic transformation of B-lymphocytes. One suitable animal system for preparing hybridomas is the murine system, which is a very well established procedure. Immunization protocols and techniques for isolation of immunized splenocytes for fusion are known in the art. For such procedures, B cells from immunized mice are fused with a suitable immortalized fusion partner, such as a murine myeloma cell line. If desired, rats or other mammals besides can be immunized instead of mice and B cells from such animals can be fused with the murine myeloma cell line to form hybridomas. Alternatively, a myeloma cell line from a source other than mouse can be used. Fusion procedures for making hybridomas also are well known. SLAM technology can also be employed in the production of antibodies.

The single chain antibodies that are provided can be formed by linking heavy and light chain variable domain (Fv region) fragments via an amino acid bridge (short peptide linker), resulting in a single polypeptide chain. Such single-chain Fvs (scFvs) can be prepared by fusing DNA encoding a peptide linker between DNAs encoding the two variable domain polypeptides ($V_L$ and $V_H$). The resulting polypeptides can fold back on themselves to form antigen-binding monomers, or they can form multimers (e.g., dimers, trimers, or tetramers), depending on the length of a flexible linker between the two variable domains (Kortt et al., (1997) *Prot. Eng.* 10:423; Kortt et al., (2001) *Biomol. Eng.* 18:95-108). By combining different $V_L$ and $V_H$-comprising polypeptides, one can form multimeric scFvs that bind to different epitopes (Kriangkum et al., (2001) *Biomol. Eng.* 18:31-40). Techniques developed for the production of single chain antibodies include those described in U.S. Pat. No. 4,946,778; Bird et al., (1988) *Science* 242:423-26; Huston et al., (1988) *Proc. Natl. Acad. Sci. U.S.A.* 85:5879-83; Ward et al., (1989) *Nature* 334:544-46, de Graaf et al., (2002) *Methods Mol. Biol.* 178:379-387. Single chain antibodies derived from antibodies provided herein include, but are not limited to scFvs comprising the variable domain combinations of the heavy and light chain variable regions depicted in Table 2, or combinations of light and heavy chain variable domains which include the CDRs depicted in Tables 3-4 and 6-23.

Antibodies provided herein that are of one subclass can be changed to antibodies from a different subclass using subclass switching methods. Thus, IgG antibodies can be derived from an IgM antibody, for example, and vice versa. Such techniques allow the preparation of new antibodies that possess the antigen binding properties of a given antibody (the parent antibody), but also exhibit biological properties associated with an antibody isotype or subclass different from that of the parent antibody. Recombinant DNA techniques can be employed. Cloned DNA encoding particular antibody polypeptides can be employed in such procedures, e.g., DNA encoding the constant domain of an antibody of the desired isotype. See, e.g., Lantto et al., (2002) *Methods Mol. Biol.* 178:303-16.

Accordingly, the antibodies that are provided include those comprising, for example, the variable domain combinations described, supra., having a desired isotype (for example, IgA, IgG1, IgG2, IgG3, IgG4, IgE, and IgD) as well as Fab or F(ab')$_2$ fragments thereof. Moreover, if an IgG4 is desired, it can also be desired to introduce a point mutation (e.g., a mutation from CPSCP to CPPCP (SEQ ID NOs 1828 and 1829, respectively, in order of appearance) in the hinge region as described in Bloom et al., (1997) *Protein Science* 6:407-15, incorporated by reference herein) to alleviate a tendency to form intra-H chain disulfide bonds that can lead to heterogeneity in the IgG4 antibodies.

Moreover, techniques for deriving antibodies having different properties (i.e., varying affinities for the antigen to which they bind) are also known. One such technique, referred to as chain shuffling, involves displaying immunoglobulin variable domain gene repertoires on the surface of filamentous bacteriophage, often referred to as phage display. Chain shuffling has been used to prepare high affinity antibodies to the hapten 2-phenyloxazol-5-one, as described by Marks et al., (1992) *Nature Biotechnology* 10:779-83.

Conservative modifications can be made to the heavy and light chain variable regions described in Table 2, or the CDRs described in Tables 3A and 3B, 4A and 4B, and Tables 6-23 (and corresponding modifications to the encoding nucleic acids) to produce an antigen binding protein having functional and biochemical characteristics. Methods for achieving such modifications are described herein.

Antigen binding proteins that specifically bind to a complex comprising β-Klotho and at least one of (i) FGFR1c, (ii) FGFR2c and (iii) FGFR3c can be further modified in various ways. For example, if they are to be used for therapeutic purposes, they can be conjugated with polyethylene glycol (PEGylated) to prolong the serum half-life or to enhance protein delivery. PEG can be attached directly to the antigen binding protein or it can be attached via a linker, such as a glycosidic linkage.

Alternatively, the V region of the subject antibodies or fragments thereof can be fused with the Fc region of a different antibody molecule. The Fc region used for this purpose can be modified so that it does not bind complement, thus reducing the likelihood of inducing cell lysis in the patient when the fusion protein is used as a therapeutic agent. In addition, the subject antibodies or functional fragments thereof can be conjugated with human serum albumin to enhance the serum half-life of the antibody or fragment thereof. Another useful fusion partner for the antigen binding proteins or fragments thereof is transthyretin (TTR). TTR has the capacity to form a tetramer, thus an antibody-TTR fusion protein can form a multivalent antibody which can increase its binding avidity.

Alternatively, substantial modifications in the functional and/or biochemical characteristics of the antigen binding proteins described herein can be achieved by creating substitutions in the amino acid sequence of the heavy and light chains that differ significantly in their effect on maintaining (a) the structure of the molecular backbone in the area of the substitution, for example, as a sheet or helical conformation, (b) the charge or hydrophobicity of the molecule at the target site, or (c) the bulkiness of the side chain. A "conservative amino acid substitution" can involve a substitution of a native amino acid residue with a normative residue that has little or no effect on the polarity or charge of the amino acid residue at that position. See, Table 8, supra. Furthermore, any native residue in the polypeptide can also be substituted with alanine, as has been previously described for alanine scanning mutagenesis.

Amino acid substitutions (whether conservative or non-conservative) of the subject antibodies can be implemented by those skilled in the art by applying routine techniques. Amino acid substitutions can be used to identify important residues of the antibodies provided herein, or to increase or decrease the affinity of these antibodies for a complex comprising β-Klotho and at least one of (i) FGFR1c, (ii) FGFR2c and (iii) FGFR3c or for modifying the binding affinity of other antigen-binding proteins described herein.

Methods of Expressing Antigen Binding Proteins

Expression systems and constructs in the form of plasmids, expression vectors, transcription or expression cassettes that comprise at least one polynucleotide as described above are also provided herein, as well host cells comprising such expression systems or constructs.

The antigen binding proteins provided herein can be prepared by any of a number of conventional techniques. For example, antigen binding proteins that specifically bind to a complex comprising β-Klotho and at least one of (i) FGFR1c, (ii) FGFR2c and (iii) FGFR3c can be produced by recombinant expression systems, using any technique known in the art. See, e.g., *Monoclonal Antibodies, Hybridomas: A New Dimension in Biological Analyses*, (Kennet et al., eds.) Plenum Press (1980) and subsequent editions; and Harlow & Lane, (1988) supra.

Antigen binding proteins can be expressed in hybridoma cell lines (e.g., in particular antibodies can be expressed in hybridomas) or in cell lines other than hybridomas. Expression constructs encoding the antibodies can be used to transform a mammalian, insect or microbial host cell. Transformation can be performed using any known method for introducing polynucleotides into a host cell, including, for example packaging the polynucleotide in a virus or bacteriophage and transducing a host cell with the construct by transfection procedures known in the art, as exemplified by U.S. Pat. Nos. 4,399,216; 4,912,040; 4,740,461; and 4,959,455. The optimal transformation procedure used will depend upon which type of host cell is being transformed. Methods for introduction of heterologous polynucleotides into mammalian cells are well known in the art and include, but are not limited to, dextran-mediated transfection, calcium phosphate precipitation, polybrene mediated transfection, protoplast fusion, electroporation, encapsulation of the polynucleotide(s) in liposomes, mixing nucleic acid with positively-charged lipids, and direct microinjection of the DNA into nuclei.

Recombinant expression constructs typically comprise a nucleic acid molecule encoding a polypeptide comprising one or more of the following: one or more CDRs provided herein; a light chain constant region; a light chain variable region; a heavy chain constant region (e.g., $C_H1$, $C_H2$ and/or $C_H3$); and/or another scaffold portion of an antigen binding protein. These nucleic acid sequences are inserted into an appropriate expression vector using standard ligation techniques. In one embodiment, the heavy or light chain constant region is appended to the C-terminus of the anti-β-Klotho/FGFR (e.g., FGFR1c, FGFR2c or FGFR3c) complex-specific heavy or light chain variable region and is ligated into an expression vector. The vector is typically selected to be functional in the particular host cell employed (i.e., the vector is compatible with the host cell machinery, permitting amplification and/or expression of the gene can occur). In some embodiments, vectors are used that employ protein-fragment complementation assays using protein reporters, such as dihydrofolate reductase (see, for example, U.S. Pat. No. 6,270,964, which is hereby incorporated by reference). Suitable expression vectors can be purchased, for example, from Invitrogen Life Technologies or BD Biosciences. Other useful vectors for cloning and expressing the antibodies and fragments include those described in Bianchi and McGrew, (2003) *Biotech. Biotechnol. Bioeng.* 84:439-44, which is hereby incorporated by reference. Additional suitable expression vectors are discussed, for example, in "Gene Expression Technology," *Methods Enzymol.*, vol. 185, (Goeddel et al., ed.), (1990), *Academic Press.*

Typically, expression vectors used in any of the host cells will contain sequences for plasmid maintenance and for cloning and expression of exogenous nucleotide sequences. Such sequences, collectively referred to as "flanking sequences" in certain embodiments will typically include one or more of the following nucleotide sequences: a promoter, one or more enhancer sequences, an origin of replication, a transcriptional termination sequence, a complete intron sequence containing a donor and acceptor splice site, a sequence encoding a leader sequence for polypeptide secretion, a ribosome binding site, a polyadenylation sequence, a polylinker region for inserting the nucleic acid encoding the polypeptide to be expressed, and a selectable marker element.

Optionally, an expression vector can contain a "tag"-encoding sequence, i.e., an oligonucleotide molecule located at the 5' or 3' end of an antigen binding protein coding sequence; the oligonucleotide sequence encodes polyHis (such as hexaHis, HHHHHH (SEQ ID NO: 1830)), or another "tag" such as FLAG, HA (hemaglutinin influenza virus), or myc, for which commercially available antibodies exist. This tag is typically fused to the polypeptide upon expression of the polypeptide, and can serve as a means for affinity purification or detection of the antigen binding protein from the host cell. Affinity purification can be accomplished, for example, by column chromatography using antibodies against the tag as an affinity matrix. Optionally, the tag can subsequently be removed from the purified antigen binding protein by various means such as using certain peptidases for cleavage.

Flanking sequences can be homologous (i.e., from the same species and/or strain as the host cell), heterologous (i.e., from a species other than the host cell species or strain), hybrid (i.e., a combination of flanking sequences from more than one source), synthetic or native. As such, the source of a flanking sequence can be any prokaryotic or eukaryotic organism, any vertebrate or invertebrate organism, or any plant, provided that the flanking sequence is functional in, and can be activated by, the host cell machinery.

Flanking sequences useful in the vectors can be obtained by any of several methods well known in the art. Typically, flanking sequences useful herein will have been previously identified by mapping and/or by restriction endonuclease digestion and can thus be isolated from the proper tissue source using the appropriate restriction endonucleases. In some cases, the full nucleotide sequence of a flanking sequence can be known. Here, the flanking sequence can be synthesized using the methods described herein for nucleic acid synthesis or cloning.

Whether all or only a portion of the flanking sequence is known, it can be obtained using polymerase chain reaction (PCR) and/or by screening a genomic library with a suitable probe such as an oligonucleotide and/or flanking sequence fragment from the same or another species. Where the flanking sequence is not known, a fragment of DNA containing a flanking sequence can be isolated from a larger piece of DNA that can contain, for example, a coding sequence or even another gene or genes. Isolation can be accomplished by restriction endonuclease digestion to produce the proper DNA fragment followed by isolation using agarose gel purification, column chromatography or other methods known to the skilled artisan. The selection of suitable enzymes to accomplish this purpose will be readily apparent to one of ordinary skill in the art.

An origin of replication is typically a part of those prokaryotic expression vectors purchased commercially, and the origin aids in the amplification of the vector in a host cell. If the vector of choice does not contain an origin of replication site, one can be chemically synthesized based on a known sequence, and ligated into the vector. For example, the origin of replication from the plasmid pBR322 (GenBank Accession # J01749, New England Biolabs, Beverly, Mass.) is suitable for most gram-negative bacteria, and various viral origins (e.g., SV40, polyoma, adenovirus, vesicular stomatitus virus (VSV), or papillomaviruses such as HPV or BPV) are useful for cloning vectors in mammalian cells. Generally, the origin of replication component is not needed for mammalian expression vectors (for example, the SV40 origin is often used only because it also contains the virus early promoter).

A transcription termination sequence is typically located 3' to the end of a polypeptide coding region and serves to terminate transcription. Usually, a transcription termination sequence in prokaryotic cells is a G-C rich fragment followed by a poly-T sequence. While the sequence is easily cloned from a library or even purchased commercially as part of a vector, it can also be readily synthesized using methods for nucleic acid synthesis such as those described herein.

A selectable marker gene encodes a protein necessary for the survival and growth of a host cell grown in a selective culture medium. Typical selection marker genes encode proteins that (a) confer resistance to antibiotics or other toxins, e.g., ampicillin, tetracycline, or kanamycin for prokaryotic host cells; (b) complement auxotrophic deficiencies of the cell; or (c) supply critical nutrients not available from complex or defined media. Specific selectable markers are the kanamycin resistance gene, the ampicillin resistance gene, and the tetracycline resistance gene. Advantageously, a neomycin resistance gene can also be used for selection in both prokaryotic and eukaryotic host cells.

Other selectable genes can be used to amplify the gene that will be expressed. Amplification is the process wherein genes that are required for production of a protein critical for growth or cell survival are reiterated in tandem within the chromosomes of successive generations of recombinant cells. Examples of suitable selectable markers for mammalian cells include dihydrofolate reductase (DHFR) and promoterless thymidine kinase genes. Mammalian cell transformants are placed under selection pressure wherein only the transformants are uniquely adapted to survive by virtue of the selectable gene present in the vector. Selection pressure is imposed by culturing the transformed cells under conditions in which the concentration of selection agent in the medium is successively increased, thereby leading to the amplification of both the selectable gene and the DNA that encodes another gene, such as an antigen binding protein that binds to a complex comprising β-Klotho and at least one of (i) FGFR1c, (ii) FGFR2c and (iii) FGFR3c. As a result, increased quantities of a polypeptide such as an antigen binding protein are synthesized from the amplified DNA.

A ribosome-binding site is usually necessary for translation initiation of mRNA and is characterized by a Shine-Dalgarno sequence (prokaryotes) or a Kozak sequence (eukaryotes). The element is typically located 3' to the promoter and 5' to the coding sequence of the polypeptide to be expressed.

In some cases, such as where glycosylation is desired in a eukaryotic host cell expression system, one can manipulate the various pre- or pro-sequences to improve glycosylation or yield. For example, one can alter the peptidase cleavage site of a particular signal peptide, or add prosequences, which also can affect glycosylation. The final protein product can have, in the −1 position (relative to the first amino acid of the mature protein), one or more additional amino acids incident to expression, which may not have been totally removed. For example, the final protein product can have one or two amino acid residues found in the peptidase cleavage site, attached to the amino-terminus. Alternatively, use of some enzyme cleavage sites can result in a slightly truncated form of the desired polypeptide, if the enzyme cuts at such area within the mature polypeptide.

Expression and cloning will typically contain a promoter that is recognized by the host organism and operably linked to the molecule encoding an antigen binding protein that specifically binds to a complex comprising β-Klotho and at least one of (i) FGFR1c, (ii) FGFR2c and (iii) FGFR3c. Promoters are untranscribed sequences located upstream (i.e., 5') to the start codon of a structural gene (generally within about 100 to 1000 bp) that control transcription of the structural gene. Promoters are conventionally grouped into one of two classes: inducible promoters and constitutive promoters. Inducible promoters initiate increased levels of transcription from DNA under their control in response to some change in culture conditions, such as the presence or absence of a nutrient or a change in temperature. Constitutive promoters, on the other hand, uniformly transcribe a gene to which they are operably linked, that is, with little or no control over gene expression. A large number of promoters, recognized by a variety of potential host cells, are well known. A suitable promoter is operably linked to the DNA encoding heavy chain or light chain comprising an antigen binding protein by removing the promoter from the source DNA by restriction enzyme digestion and inserting the desired promoter sequence into the vector.

Suitable promoters for use with yeast hosts are also well known in the art. Yeast enhancers are advantageously used with yeast promoters. Suitable promoters for use with mammalian host cells are well known and include, but are not limited to, those obtained from the genomes of viruses such as polyoma virus, fowlpox virus, adenovirus (such as Adenovirus 2), bovine papilloma virus, avian sarcoma virus, cytomegalovirus, retroviruses, hepatitis-B virus, and Simian Virus 40 (SV40). Other suitable mammalian promoters include heterologous mammalian promoters, for example, heat-shock promoters and the actin promoter.

Additional promoters which can be of interest include, but are not limited to: SV40 early promoter (Benoist & Chambon, (1981) *Nature* 290:304-310); CMV promoter (Thomsen et al., (1984) *Proc. Natl. Acad. U.S.A.* 81:659-663); the promoter contained in the 3' long terminal repeat of Rous sarcoma virus (Yamamoto et al., (1980) *Cell* 22:787-97); herpes thymidine kinase promoter (Wagner et al., (1981) *Proc. Natl. Acad. Sci. U.S.A.* 78:1444-45); promoter and regulatory sequences from the metallothionine gene (Prinster et al., (1982) *Nature* 296:39-42); and prokaryotic promoters such as the beta-lactamase promoter (Villa-Kamaroff et al., (1978) *Proc. Natl. Acad. Sci. U.S.A.* 75:3727-31); or the tac promoter (DeBoer et al., (1983) *Proc. Natl. Acad. Sci. U.S.A.* 80:21-25). Also of interest are the following animal transcriptional control regions, which exhibit tissue specificity and have been utilized in transgenic animals: the elastase I gene control region that is active in pancreatic acinar cells (Swift et al., (1984) *Cell* 38:639-46; Ornitz et al., (1986) Cold Spring Harbor Symp. Quant. Biol. 50:399-409; MacDonald, (1987) *Hepatology* 7:425-515); the insulin gene control region that is active in pancreatic beta cells (Hanahan, (1985) *Nature* 315:115-22); the immunoglobulin gene control region that is active in lymphoid cells (Grosschedl et al., (1984) *Cell* 38:647-58; Adames et al., (1985) *Nature* 318:533-38; Alexander et al., (1987) *Mol. Cell. Biol.* 7:1436-44); the mouse mammary tumor virus control region that is active in testicular, breast, lymphoid and mast cells (Leder et al., (1986) *Cell* 45:485-95); the albumin gene control region that is active in liver (Pinkert et al., (1987) *Genes and Devel.* 1:268-76); the alpha-feto-protein gene control region that is active in liver (Krumlauf et al., (1985) *Mol. Cell. Biol.* 5:1639-48; Hammer et al., (1987) *Science* 253:53-58); the alpha 1-antitrypsin gene control region that is active in liver (Kelsey et al., (1987) *Genes and Devel.* 1:161-71); the beta-globin gene control region that is active in myeloid cells (Mogram et al., (1985) *Nature* 315:338-40; Kollias et al., (1986) *Cell* 46:89-94); the myelin basic protein gene control region that is active in oligodendrocyte cells in the brain (Readhead et al., (1987) *Cell* 48:703-12); the myosin light chain-2 gene control region that is active in skeletal muscle (Sani, (1985) *Nature* 314:283-86); and the gonadotropic releasing hormone gene control region that is active in the hypothalamus (Mason et al., (1986) *Science* 234:1372-78).

An enhancer sequence can be inserted into the vector to increase transcription of DNA encoding light chain or heavy chain comprising an antigen binding protein that specifically binds to a complex comprising β-Klotho and at least one of (i) FGFR1c, (ii) FGFR2c and (iii) FGFR3c by higher eukaryotes, e.g., a human antigen binding protein that specifically binds to a complex comprising β-Klotho and at least one of (i) FGFR1c, (ii) FGFR2c and (iii) FGFR3c. Enhancers are cis-acting elements of DNA, usually about 10-300 bp in length, that act on the promoter to increase transcription. Enhancers are relatively orientation and position independent, having been found at positions both 5' and 3' to the transcription unit. Several enhancer sequences available from mammalian genes are known (e.g., globin, elastase, albumin, alpha-feto-protein and insulin). Typically, however, an enhancer from a virus is used. The SV40 enhancer, the cytomegalovirus early promoter enhancer, the polyoma enhancer, and adenovirus enhancers known in the art are exemplary enhancing elements for the activation of eukaryotic promoters. While an enhancer can be positioned in the vector either 5' or 3' to a coding sequence, it is typically located at a site 5' from the promoter. A sequence encoding an appropriate native or heterologous signal sequence (leader sequence or signal peptide) can be incorporated into an expression vector, to promote extracellular secretion of the antibody. The choice of signal peptide or leader depends on the type of host cells in which the antibody is to be produced, and a heterologous signal sequence can replace the native signal sequence. Examples of signal peptides that are functional in mammalian host cells include the following: the signal sequence for interleukin-7 (IL-7) described in U.S. Pat. No. 4,965,195; the signal sequence for interleukin-2 receptor described in Cosman et al., (1984) *Nature* 312:768-71; the interleukin-4 receptor signal peptide described in EP Patent No. 0367 566; the type I interleukin-1 receptor signal peptide described in U.S. Pat. No. 4,968,607; the type II interleukin-1 receptor signal peptide described in EP Patent No. 0 460 846.

Expression vectors can be constructed from a starting vector such as a commercially available vector. Such vectors can but need not contain all of the desired flanking sequences. Where one or more of the flanking sequences are not already present in the vector, they can be individually obtained and ligated into the vector. Methods used for obtaining each of the flanking sequences are well known to one skilled in the art.

After the vector has been constructed and a nucleic acid molecule encoding light chain, a heavy chain, or a light chain and a heavy chain comprising an antigen binding protein that specifically binds to a complex comprising β-Klotho and at least one of (i) FGFR1c, (ii) FGFR2c and (iii) FGFR3c has been inserted into the proper site of the vector, the completed vector can be inserted into a suitable host cell for amplification and/or polypeptide expression. The transformation of an expression vector for an antigen binding protein into a selected host cell can be accomplished by well known methods including transfection, infection, calcium phosphate co-precipitation, electroporation, microinjection, lipofection, DEAE-dextran mediated transfection, or other known techniques. The method selected will in part be a function of the type of host cell to be used. These methods and other suitable methods are well known to the skilled artisan, and are set forth, for example, in Sambrook et al., (2001), supra.

A host cell, when cultured under appropriate conditions, synthesizes an antigen binding protein that can subsequently be collected from the culture medium (if the host cell secretes it into the medium) or directly from the host cell producing it (if it is not secreted). The selection of an appropriate host cell will depend upon various factors, such as desired expression levels, polypeptide modifications that are desirable or necessary for activity (such as glycosylation or phosphorylation) and ease of folding into a biologically active molecule.

Mammalian cell lines available as hosts for expression are well known in the art and include, but are not limited to, immortalized cell lines available from the American Type Culture Collection (ATCC), including but not limited to HeLa cells, Human Embryonic Kidney 293 cells (HEK293 cells), Chinese hamster ovary (CHO) cells, HeLa cells, baby hamster kidney (BHK) cells, monkey kidney cells (COS), human hepatocellular carcinoma cells (e.g., Hep G2), and a number of other cell lines. In certain embodiments, cell lines can be selected through determining which cell lines have high expression levels and constitutively produce antigen binding proteins with desirable binding properties (e.g., the ability to bind to a complex comprising β-Klotho and at least one of (i) FGFR1c, (ii) FGFR2c and (iii) FGFR3c). In another embodiment, a cell line from the B cell lineage that does not make its own antibody but has a capacity to make and secrete a heterologous antibody can be selected. The ability to induce FGF21-like signaling can also form a selection criterion.

Uses of Antigen Binding Proteins for Diagnostic and Therapeutic Purposes

The antigen binding proteins disclosed herein are useful for detecting to a complex comprising β-Klotho and at least one of (i) FGFR1c, (ii) FGFR2c and (iii) FGFR3c in biological samples and identification of cells or tissues that produce one or more of β-Klotho and at least one of (i) FGFR1c, (ii) FGFR2c and (iii) FGFR3c. For instance, the antigen binding proteins disclosed herein can be used in diagnostic assays, e.g., binding assays to detect and/or quantify a complex comprising β-Klotho and at least one of (i) FGFR1c, (ii) FGFR2c and (iii) FGFR3c expressed in a tissue or cell.

Antigen binding proteins that specifically bind to a complex comprising β-Klotho and at least one of (i) FGFR1c, (ii) FGFR2c and (iii) FGFR3c can also be used in treatment of diseases related to FGF21-like signaling in a patient in need thereof, such as type 2 diabetes, obesity, dyslipidemia, NASH, cardiovascular disease, and metabolic syndrome. By forming a signaling complex comprising an antigen binding protein and a complex comprising β-Klotho and at least one of (i) FGFR1c, (ii) FGFR2c and (iii) FGFR3c, the natural in vivo activity of FGF21, which associates with a complex comprising β-Klotho and at least one of (i) FGFR1c, (ii) FGFR2c and (iii) FGFR3c in vivo to initiate signaling, can be mimicked and/or enhanced, leading to therapeutic effects.

Indications

A disease or condition associated with human FGF21 includes any disease or condition whose onset in a patient is influenced by, at least in part, the lack of or therapeutically insufficient induction of FGF21-like signaling, which is initiated in vivo by the formation of a complex comprising β-Klotho and at least one of (i) FGFR1c, (ii) FGFR2c and (iii) FGFR3c. The severity of the disease or condition can also be decreased by the induction of FGF21-like signaling. Examples of diseases and conditions that can be treated with the antigen binding proteins provided herein include type 2 diabetes, obesity, dyslipidemia, NASH, cardiovascular disease, and metabolic syndrome.

The antigen binding proteins described herein can be used to treat type 2 diabetes, obesity, dyslipidemia, NASH, cardiovascular disease, and metabolic syndrome, or can be employed as a prophylactic treatment administered, e.g., daily, weekly, biweekly, monthly, bimonthly, biannually, etc to prevent or reduce the frequency and/or severity of symptoms, e.g., elevated plasma glucose levels, elevated triglycerides and/or cholesterol levels, thereby providing an improved glycemic and cardiovascular risk factor profile.

Diagnostic Methods

The antigen binding proteins described herein can be used for diagnostic purposes to detect, diagnose, or monitor diseases and/or conditions associated with FGFR1c, FGFR2c, FGFR3c, β-Klotho, FGF21 and/or complexes comprising combinations thereof. Also provided are methods for the detection of the presence of to a complex comprising β-Klotho and at least one of (i) FGFR1c, (ii) FGFR2c and (iii) FGFR3c in a sample using classical immunohistological methods known to those of skill in the art (e.g., Tijssen, (1985) "Practice and Theory of Enzyme Immunoassays" in *Laboratory Techniques in Biochemistry and Molecular Biology*, 15 (Burdon & van Knippenberg, eds.), Elsevier Biomedical); Zola, (1987) *Monoclonal Anti-* bodies: *A Manual of Techniques*, pp. 147-58 (CRC Press, Inc.); Jalkanen et al., (1985) *J. Cell. Biol.* 101:976-85; Jalkanen et al., (1987) *J. Cell Biol.* 105:3087-96). The detection of a complex comprising β-Klotho and at least one of (i) FGFR1c, (ii) FGFR2c and (iii) FGFR3c can be performed in vivo or in vitro.

Diagnostic applications provided herein include use of the antigen binding proteins to detect expression/formation of a complex comprising β-Klotho and at least one of (i) FGFR1c, (ii) FGFR2c and (iii) FGFR3c, and/or binding to a complex comprising β-Klotho and at least one of (i) FGFR1c, (ii) FGFR2c and (iii) FGFR3c. Examples of methods useful in the detection of the presence of a complex comprising β-Klotho and at least one of (i) FGFR1c, (ii) FGFR2c and (iii) FGFR3c include immunoassays, such as the enzyme linked immunosorbent assay (ELISA) and the radioimmunoassay (RIA).

For diagnostic applications, the antigen binding protein typically will be labeled with a detectable labeling group. Suitable labeling groups include, but are not limited to, the following: radioisotopes or radionuclides (e.g., $^3$H, $^{14}$C, $^{15}$N, $^{35}$S, $^{90}$Y, $^{99}$Tc, $^{111}$In, $^{125}$I, $^{131}$I), fluorescent groups (e.g., FITC, rhodamine, lanthanide phosphors), enzymatic groups (e.g., horseradish peroxidase, β-galactosidase, luciferase, alkaline phosphatase), chemiluminescent groups, biotinyl groups, or predetermined polypeptide epitopes recognized by a secondary reporter (e.g., leucine zipper pair sequences, binding sites for secondary antibodies, metal binding domains, epitope tags). In some embodiments, the labeling group is coupled to the antigen binding protein via spacer arms of various lengths to reduce potential steric hindrance. Various methods for labeling proteins are known in the art and can be used.

In another aspect, an antigen binding protein can be used to identify a cell or cells that express a complex comprising β-Klotho and at least one of (i) FGFR1c, (ii) FGFR2c and (iii) FGFR3c. In a specific embodiment, the antigen binding protein is labeled with a labeling group and the binding of the labeled antigen binding protein to a complex comprising β-Klotho and at least one of (i) FGFR1c, (ii) FGFR2c and (iii) FGFR3c is detected. In a further specific embodiment, the binding of the antigen binding protein to a complex comprising β-Klotho and at least one of (i) FGFR1c, (ii) FGFR2c and (iii) FGFR3c detected in vivo. In a further specific embodiment, the antigen binding protein is isolated and measured using techniques known in the art. See, for example, Harlow & Lane, (1988) supra; *Current Protocols In Immunology* (John E. Coligan, ed), John Wiley & Sons (1993 ed., and supplements and/or updates).

Another aspect provides for detecting the presence of a test molecule that competes for binding to a complex comprising β-Klotho and at least one of (i) FGFR1c, (ii) FGFR2c and (iii) FGFR3c with the antigen binding proteins provided, as disclosed herein. An example of one such assay could involve detecting the amount of free antigen binding protein in a solution containing an amount of a complex comprising β-Klotho and at least one of (i) FGFR1c, (ii) FGFR2c and (iii) FGFR3c in the presence or absence of the test molecule. An increase in the amount of free antigen binding protein (i.e., the antigen binding protein not bound to a complex comprising β-Klotho and at least one of (i) FGFR1c, (ii) FGFR2c and (iii) FGFR3c) would indicate that the test molecule is capable of competing for binding to a complex comprising β-Klotho and at least one of (i) FGFR1c, (ii) FGFR2c and (iii) FGFR3c with the antigen binding protein. In one embodiment, the antigen binding protein is labeled with a labeling group. Alternatively, the test molecule is labeled and the amount of free test molecule is monitored in the presence and absence of an antigen binding protein.

Methods of Treatment: Pharmaceutical Formulations and Routes of Administration

Methods of using the disclosed antigen binding proteins are also provided. In some methods, an antigen binding protein is provided to a patient, which induces FGF21-like signaling.

Pharmaceutical compositions that comprise a therapeutically effective amount of one or a plurality of the antigen binding proteins and a pharmaceutically acceptable diluent, carrier, solubilizer, emulsifier, preservative, and/or adjuvant are also provided. In addition, methods of treating a patient by administering such pharmaceutical composition are included. The term "patient" includes human patients.

Acceptable formulation materials are nontoxic to recipients at the dosages and concentrations employed. In specific embodiments, pharmaceutical compositions comprising a therapeutically effective amount of human antigen binding proteins that specifically bind to a complex comprising β-Klotho and at least one of (i) FGFR1c, (ii) FGFR2c and (iii) FGFR3c are provided.

In certain embodiments, acceptable formulation materials preferably are nontoxic to recipients at the dosages and concentrations employed. In certain embodiments, the pharmaceutical composition can contain formulation materials for modifying, maintaining or preserving, for example, the pH, osmolarity, viscosity, clarity, color, isotonicity, odor, sterility, stability, rate of dissolution or release, adsorption or penetration of the composition. In such embodiments, suitable formulation materials include, but are not limited to, amino acids (such as glycine, glutamine, asparagine, arginine or lysine); antimicrobials; antioxidants (such as ascorbic acid, sodium sulfite or sodium hydrogen-sulfite); buffers (such as borate, bicarbonate, Tris-HCl, citrates, phosphates or other organic acids); bulking agents (such as mannitol or glycine); chelating agents (such as ethylenediamine tetraacetic acid (EDTA)); complexing agents (such as caffeine, polyvinylpyrrolidone, beta-cyclodextrin or hydroxypropyl-beta-cyclodextrin); fillers; monosaccharides; disaccharides; and other carbohydrates (such as glucose, mannose or dextrins); proteins (such as serum albumin, gelatin or immunoglobulins); coloring, flavoring and diluting agents; emulsifying agents; hydrophilic polymers (such as polyvinylpyrrolidone); low molecular weight polypeptides; salt-forming counterions (such as sodium); preservatives (such as benzalkonium chloride, benzoic acid, salicylic acid, thimerosal, phenethyl alcohol, methylparaben, propylparaben, chlorhexidine, sorbic acid or hydrogen peroxide); solvents (such as glycerin, propylene glycol or polyethylene glycol); sugar alcohols (such as mannitol or sorbitol); suspending agents; surfactants or wetting agents (such as Pluronics, PEG, sorbitan esters, polysorbates such as polysorbate 20, polysorbate, triton, tromethamine, lecithin, cholesterol, tyloxapal); stability enhancing agents (such as sucrose or sorbitol); tonicity enhancing agents (such as alkali metal halides, preferably sodium or potassium chloride, mannitol sorbitol); delivery vehicles; diluents; excipients and/or pharmaceutical adjuvants. See, e.g., *Remington's Pharmaceutical Sciences*, 18th Edition, (A. R. Gennaro, ed.), 1990, Mack Publishing Company, and subsequent editions.

In certain embodiments, the optimal pharmaceutical composition will be determined by one skilled in the art depending upon, for example, the intended route of administration, delivery format and desired dosage. See, for example, *Rem-*

*ington's Pharmaceutical Sciences*, supra. In certain embodiments, such compositions can influence the physical state, stability, rate of in vivo release and rate of in vivo clearance of the antigen binding proteins disclosed. In certain embodiments, the primary vehicle or carrier in a pharmaceutical composition can be either aqueous or non-aqueous in nature. For example, a suitable vehicle or carrier can be water for injection, physiological saline solution or artificial cerebrospinal fluid, possibly supplemented with other materials common in compositions for parenteral administration. Neutral buffered saline or saline mixed with serum albumin are further exemplary vehicles. In specific embodiments, pharmaceutical compositions comprise Tris buffer of about pH 7.0-8.5, or acetate buffer of about pH 4.0-5.5, and can further include sorbitol or a suitable substitute. In certain embodiments, compositions comprising antigen binding proteins that specifically bind to a complex comprising β-Klotho and at least one of (i) FGFR1c, (ii) FGFR2c and (iii) FGFR3c can be prepared for storage by mixing the selected composition having the desired degree of purity with optional formulation agents (see, *Remington's Pharmaceutical Sciences*, supra for examples of suitable formulation agents) in the form of a lyophilized cake or an aqueous solution. Further, in certain embodiments, antigen binding proteins that bind to a complex comprising β-Klotho and at least one of (i) FGFR1c, (ii) FGFR2c and (iii) FGFR3c can be formulated as a lyophilizate using appropriate excipients such as sucrose.

The pharmaceutical compositions can be selected for parenteral delivery. Alternatively, the compositions can be selected for inhalation or for delivery through the digestive tract, such as orally. Preparation of such pharmaceutically acceptable compositions is within the skill of the art.

The formulation components are present preferably in concentrations that are acceptable to the site of administration. In certain embodiments, buffers are used to maintain the composition at physiological pH or at a slightly lower pH, typically within a pH range of from about 5 to about 8.

When parenteral administration is contemplated, the therapeutic compositions can be provided in the form of a pyrogen-free, parenterally acceptable aqueous solution comprising the desired antigen binding protein in a pharmaceutically acceptable vehicle. A particularly suitable vehicle for parenteral injection is sterile distilled water in which the antigen binding protein is formulated as a sterile, isotonic solution, properly preserved. In certain embodiments, the preparation can involve the formulation of the desired molecule with an agent, such as injectable microspheres, bio-erodible particles, polymeric compounds (such as polylactic acid or polyglycolic acid), beads or liposomes, that can provide controlled or sustained release of the product which can be delivered via depot injection. In certain embodiments, hyaluronic acid can also be used, which can have the effect of promoting sustained duration in the circulation. In certain embodiments, implantable drug delivery devices can be used to introduce the desired antigen binding protein.

Certain pharmaceutical compositions are formulated for inhalation. In some embodiments, antigen binding proteins that bind to a complex comprising β-Klotho and at least one of (i) FGFR1c, (ii) FGFR2c and (iii) FGFR3c are formulated as a dry, inhalable powder. In specific embodiments, antigen binding protein inhalation solutions can also be formulated with a propellant for aerosol delivery. In certain embodiments, solutions can be nebulized. Pulmonary administration and formulation methods therefore are further described in International Patent Application No. PCT/US94/001875, which is incorporated by reference and describes pulmonary delivery of chemically modified proteins. Some formulations can be administered orally. Antigen binding proteins that specifically bind to a complex comprising β-Klotho and at least one of (i) FGFR1c, (ii) FGFR2c and (iii) FGFR3c that are administered in this fashion can be formulated with or without carriers customarily used in the compounding of solid dosage forms such as tablets and capsules. In certain embodiments, a capsule can be designed to release the active portion of the formulation at the point in the gastrointestinal tract when bioavailability is maximized and pre-systemic degradation is minimized. Additional agents can be included to facilitate absorption of an antigen binding protein. Diluents, flavorings, low melting point waxes, vegetable oils, lubricants, suspending agents, tablet disintegrating agents, and binders can also be employed.

Some pharmaceutical compositions comprise an effective quantity of one or a plurality of human antigen binding proteins that specifically bind to a complex comprising β-Klotho and at least one of (i) FGFR1c, (ii) FGFR2c and (iii) FGFR3c in a mixture with non-toxic excipients that are suitable for the manufacture of tablets. By dissolving the tablets in sterile water, or another appropriate vehicle, solutions can be prepared in unit-dose form. Suitable excipients include, but are not limited to, inert diluents, such as calcium carbonate, sodium carbonate or bicarbonate, lactose, or calcium phosphate; or binding agents, such as starch, gelatin, or acacia; or lubricating agents such as magnesium stearate, stearic acid, or talc.

Additional pharmaceutical compositions will be evident to those skilled in the art, including formulations involving antigen binding proteins that specifically bind to a complex comprising β-Klotho and at least one of (i) FGFR1c, (ii) FGFR2c and (iii) FGFR3c in sustained- or controlled-delivery formulations. Techniques for formulating a variety of other sustained- or controlled-delivery means, such as liposome carriers, bio-erodible microparticles or porous beads and depot injections, are also known to those skilled in the art. See, for example, International Patent Application No. PCT/US93/00829, which is incorporated by reference and describes controlled release of porous polymeric microparticles for delivery of pharmaceutical compositions. Sustained-release preparations can include semipermeable polymer matrices in the form of shaped articles, e.g., films, or microcapsules. Sustained release matrices can include polyesters, hydrogels, polylactides (as disclosed in U.S. Pat. No. 3,773,919 and European Patent Application Publication No. EP 058481, each of which is incorporated by reference), copolymers of L-glutamic acid and gamma ethyl-L-glutamate (Sidman et al., (1983) *Biopolymers* 2:547-556), poly (2-hydroxyethyl-inethacrylate) (Langer et al., (1981) *J. Biomed. Mater. Res.* 15:167-277 and Langer, (1982) *Chem. Tech.* 12:98-105), ethylene vinyl acetate (Langer et al., (1981) supra) or poly-D(−)-3-hydroxybutyric acid (European Patent Application Publication No. EP 133988). Sustained release compositions can also include liposomes that can be prepared by any of several methods known in the art. See, e.g., Eppstein et al., (1985) *Proc. Natl. Acad. Sci. U.S.A.* 82:3688-3692; European Patent Application Publication Nos. EP 036676; EP 088046 and EP 143949, incorporated by reference.

Pharmaceutical compositions used for in vivo administration are typically provided as sterile preparations. Sterilization can be accomplished by filtration through sterile filtration membranes. When the composition is lyophilized, sterilization using this method can be conducted either prior to or following lyophilization and reconstitution. Compositions for parenteral administration can be stored in lyophilized form or in a solution. Parenteral compositions generally are placed into a container having a sterile access port, for example, an intravenous solution bag or vial having a stopper pierceable by a hypodermic injection needle.

In certain embodiments, cells expressing a recombinant antigen binding protein as disclosed herein are encapsulated for delivery (see, Tao et al., *Invest. Ophthalmol Vis Sci* (2002) 43:3292-3298 and Sieving et al., *Proc. Natl. Acad. Sciences USA* (2006) 103:3896-3901).

In certain formulations, an antigen binding protein has a concentration of between 10 mg/ml and 150 mg/ml. Some formulations contain a buffer, sucrose and polysorbate. An example of a formulation is one containing 50-100 mg/ml of antigen binding protein, 5-20 mM sodium acetate, 5-10% w/v sucrose, and 0.002-0.008% w/v polysorbate. Certain, formulations, for instance, contain 1-100 mg/ml of an antigen binding protein in 9-11 mM sodium acetate buffer, 8-10% w/v sucrose, and 0.005-0.006% w/v polysorbate. The pH of certain such formulations is in the range of 4.5-6. Other formulations can have a pH of 5.0-5.5.

Once the pharmaceutical composition has been formulated, it can be stored in sterile vials as a solution, suspension, gel, emulsion, solid, crystal, or as a dehydrated or lyophilized powder. Such formulations can be stored either in a ready-to-use form or in a form (e.g., lyophilized) that is reconstituted prior to administration. Kits for producing a single-dose administration unit are also provided. Certain kits contain a first container having a dried protein and a second container having an aqueous formulation. In certain embodiments, kits containing single and multi-chambered pre-filled syringes (e.g., liquid syringes and lyosyringes) are provided. The therapeutically effective amount of an antigen binding protein-containing pharmaceutical composition to be employed will depend, for example, upon the therapeutic context and objectives. One skilled in the art will appreciate that the appropriate dosage levels for treatment will vary depending, in part, upon the molecule delivered, the indication for which the antigen binding protein is being used, the route of administration, and the size (body weight, body surface or organ size) and/or condition (the age and general health) of the patient. In certain embodiments, the clinician can titer the dosage and modify the route of administration to obtain the optimal therapeutic effect.

A typical dosage can range from about 1 µg/kg to up to about 30 mg/kg or more, depending on the factors mentioned above. In specific embodiments, the dosage can range from 10 µg/kg up to about 35 mg/kg, optionally from 0.1 mg/kg up to about 35 mg/kg, alternatively from 0.3 mg/kg up to about 20 mg/kg. In some applications, the dosage is from 0.5 mg/kg to 20 mg/kg and in other applications the dosage is from 21-100 mg/kg. In some instances, an antigen binding protein is dosed at 0.3-20 mg/kg. The dosage schedule in some treatment regimes is at a dose of 0.3 mg/kg qW-20 mg/kg qW.

Dosing frequency will depend upon the pharmacokinetic parameters of the particular antigen binding protein in the formulation used. Typically, a clinician administers the composition until a dosage is reached that achieves the desired effect. The composition can therefore be administered as a single dose, or as two or more doses (which can but need not contain the same amount of the desired molecule) over time, or as a continuous infusion via an implantation device or catheter. Appropriate dosages can be ascertained through use of appropriate dose-response data. In certain embodiments, the antigen binding proteins can be administered to patients throughout an extended time period. Chronic administration of an antigen binding protein minimizes the adverse immune or allergic response commonly associated with antigen binding proteins that are not fully human, for example an antibody raised against a human antigen in a non-human animal, for example, a non-fully human antibody or non-human antibody produced in a non-human species.

The route of administration of the pharmaceutical composition is in accord with known methods, e.g., orally, through injection by intravenous, intraperitoneal, intracerebral (intra-parenchymal), intracerebroventricular, intramuscular, intra-ocular, intraarterial, intraportal, or intralesional routes; by sustained release systems or by implantation devices. In certain embodiments, the compositions can be administered by bolus injection or continuously by infusion, or by implantation device.

The composition also can be administered locally via implantation of a membrane, sponge or another appropriate material onto which the desired molecule has been absorbed or encapsulated. In certain embodiments, where an implantation device is used, the device can be implanted into any suitable tissue or organ, and delivery of the desired molecule can be via diffusion, timed-release bolus, or continuous administration.

It also can be desirable to use antigen binding protein pharmaceutical compositions ex vivo. In such instances, cells, tissues or organs that have been removed from the patient are exposed to antigen binding protein pharmaceutical compositions after which the cells, tissues and/or organs are subsequently implanted back into the patient.

In particular, antigen binding proteins that specifically bind to a complex comprising β-Klotho and at least one of (i) FGFR1c, (ii) FGFR2c and (iii) FGFR3c can be delivered by implanting certain cells that have been genetically engineered, using methods such as those described herein and known in the art, to express and secrete the polypeptide. In certain embodiments, such cells can be animal or human cells, and can be autologous, heterologous, or xenogeneic. In certain embodiments, the cells can be immortalized. In other embodiments, in order to decrease the chance of an immunological response, the cells can be encapsulated to avoid infiltration of surrounding tissues. In further embodiments, the encapsulation materials are typically biocompatible, semi-permeable polymeric enclosures or membranes that allow the release of the protein product(s) but prevent the destruction of the cells by the patient's immune system or by other detrimental factors from the surrounding tissues.

Combination Therapies

In another aspect, the present disclosure provides a method of treating a subject for diabetes with a therapeutic antigen binding protein of the present disclosure, such as the fully human therapeutic antibodies described herein, together with one or more other treatments. In one embodiment, such a combination therapy achieves an additive or synergistic effect. The antigen binding proteins can be administered in combination with one or more of the type 2 diabetes or obesity treatments currently available. These treatments for diabetes include biguanide (metaformin), and sulfonylureas (such as glyburide, glipizide). Additional treatments directed at maintaining glucose homeostasis include PPAR gamma agonists (pioglitazone, rosiglitazone); glinides (meglitinide, repaglinide, and nateglinide); DPP-4 inhibitors (Januvia® and Onglyza®) and alpha glucosidase inhibitors (acarbose, voglibose).

Additional combination treatments for diabetes include injectable treatments such as insulin and incretin mimetics (Byetta®, Exenatide®), other GLP-1 (glucagon-like peptide) analogs such as Victoza® (liraglutide), other GLP-1R agonists and Symlin® (pramlintide).

Additional combination treatments directed at weight loss include Meridia® and Xenical®.

EXAMPLES

The following examples, including the experiments conducted and the results achieved, are provided for illustrative purposes only and are not to be construed as limiting.

Example 1

Preparation of FGFR1c and β-Klotho Over Expressing Cells for Use as an Antigen

Figure 1B:
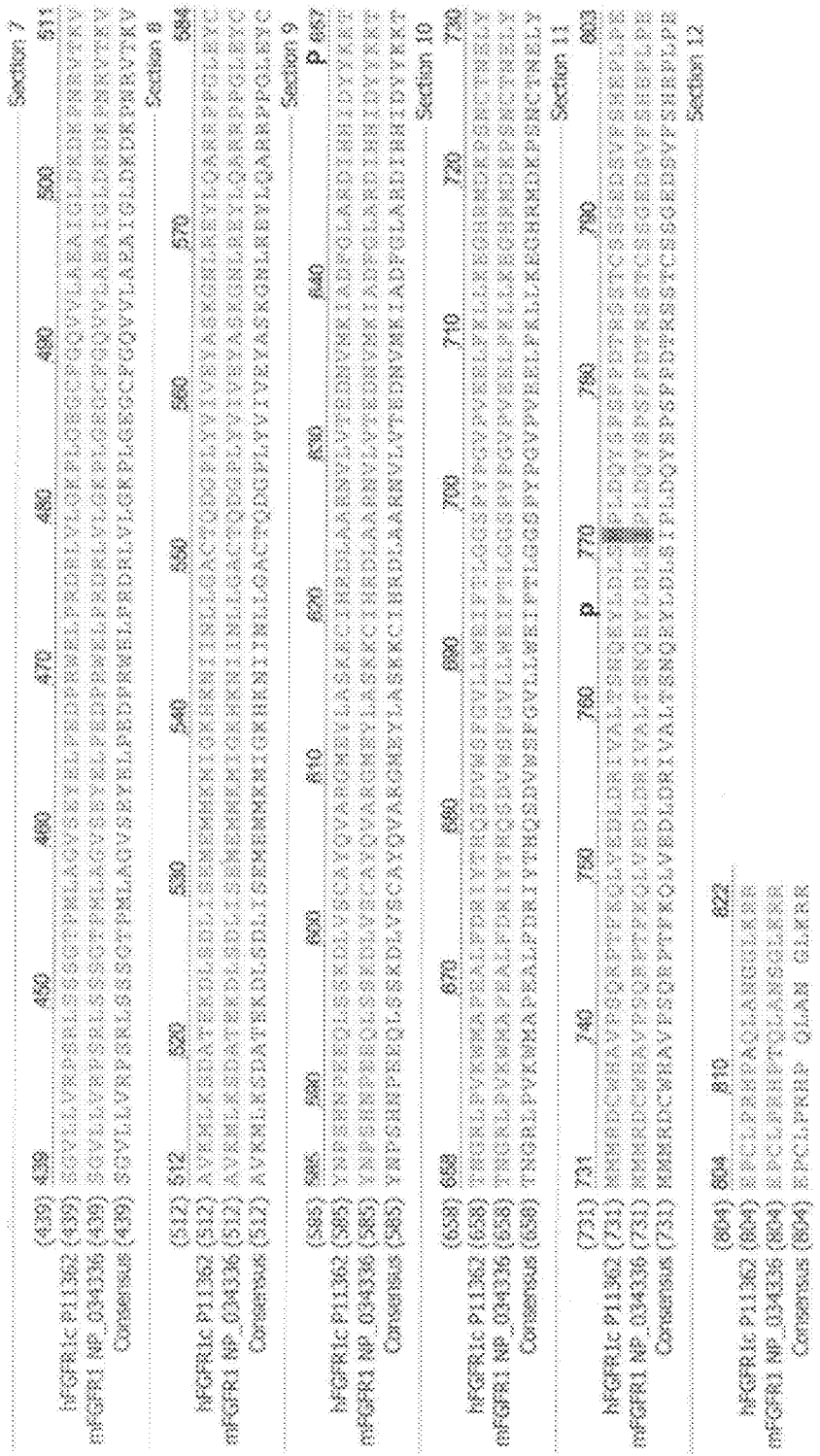
Figure 2A:
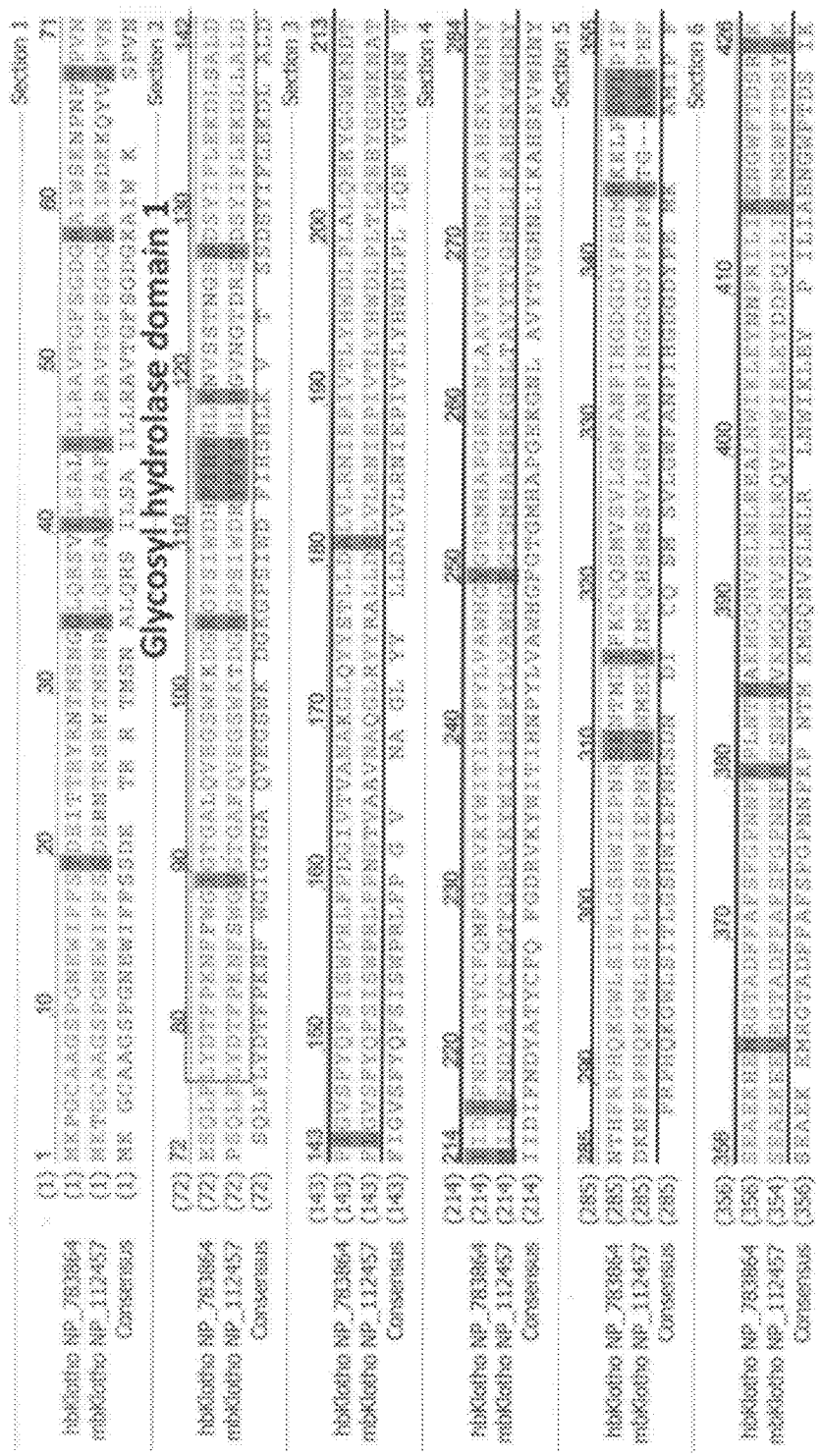
FIG. 2a-2c is an alignment showing the sequence homology between human β-Klotho (GenBank Accession No NP_783864; SEQ ID NO: 7) and murine β-Klotho (GenBank Accession No NP_112457; SEQ ID NO: 10); various features are highlighted, including the transmembrane sequence and two glycosyl hydrolase domains, and a consensus sequence (SEQ ID NO: 1834) is provided.
Figure 2B:
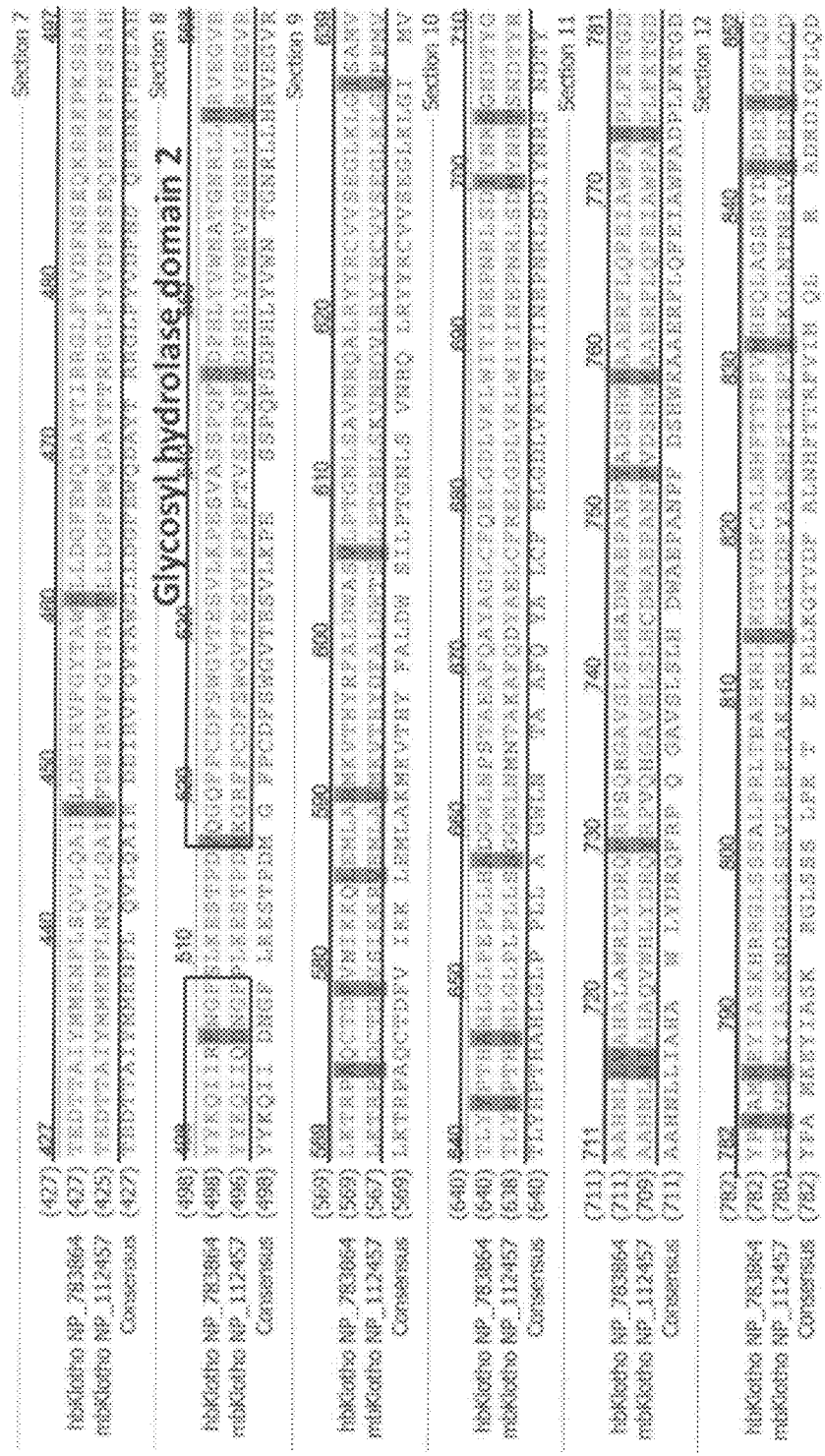
Figure 2C:
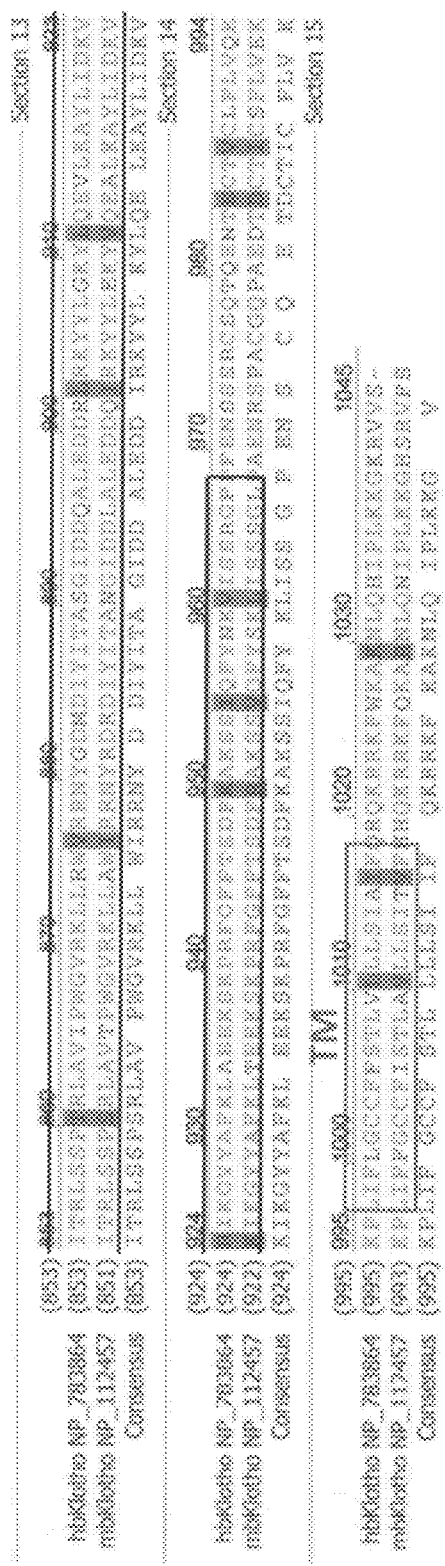

Nucleic acid sequences encoding the full length human FGFR1c polypepetide (SEQ ID NO: 4; FIGS. 1A-1B) and a separate sequence encoding the full length human β-Klotho polypeptide (SEQ ID NO: 7; FIGS. 2A-2C) were subcloned into suitable mammalian cell expression vectors (e.g., pcDNA3.1 Zeo, pcDNA3.1 Hyg (Invitrogen, Carlsbad, Calif.) or pDSRα24. The pDSRα24 vector contains SV40 early promoter/enhancer for expressing the gene of interest and a mouse DHFR expression cassette for selection in CHO DHFR (−) host cells such as AM1/D CHO (a derivative of DG44, CHO DHFR (−)).

AM-1/D CHO cells were transfected with linearized DNAs of huFGFR1c and huβ-Klotho in standard mammalian cell expression vectors e.g. pcDNA3.1 puro and pcDNA3.1 Hyg with Lipofectamine 2000 (Invitrogen, Carlsbad Calif.). The transfected cells were trypsinized 2 days after transfection and seeded into media containing the corresponding selection drugs i.e. puromycin and hygromycin. After 2 weeks, the resulting transfected colonies were trypsinized and pooled. Single cell clones from the pools were isolated and screened with antibodies to huFGFR1c and huβKlotho in FACS and Clone 16 was selected due to the high level and balanced expression of the two receptor components.

2×10e9 fresh cells from Clone 16 were harvested from roller bottles into a smaller volume in PBS and incubated with 10 µg/ml recombinant FGF21 (Amgen, Thousand Oaks Calif.) at 4 C for 1 hours to form complex with the cell surface receptors. The cells were washed twice with cold PBS, pelleted by centrifugation and frozen in individual vials at 2×10e8 cells for immunization.

HEK 293T cells were transfected with DNA expressing a truncated version of huFGFR1c (a signal peptide VH21 was joined to the remaining FGFR1c from amino acid residue #141 to #822 (in SEQ ID NO: 4) with a deletion that removed both the D1 domain and the acidic box (AB) and DNA expressing the full length huβ-Klotho in pcDNA3.1 series or pTT5 (an expression vector developed by Durocher, NRCC, with CMV promoter and EBV ori) based vector for transient expression. The removal of the D1-AB on FGFR1c was designed to expose epitopes on FGFR1c (e.g., in the D2 and D3 domains) that may be masked by this auto-inhibitory domain (see Mohammadi et al., (2005) *Cytokine Growth Factor Reviews*, 16, 107-137; Gupte et al., (2011) *J. Mol. Biol.* 408:491-502).

The expression of β-Klotho and truncated FGFR1c in the transfected 293T cells was verified by the respective specific antibodies in FACS and cells were harvested on day 3 post-transfection and frozen as cell pellet into aliquots for immunization.

Stable CHO or transiently transfected HEK 293T cells expressing FGFR1c and β-Klotho individually or together were also generated and used for titering mouse sera by FACS after immunization and for binding screens of the hybridoma supernatants by FMAT (see Example 3).

Example 2

Preparation of Monoclonal Antibodies

Immunizations were conducted using one or more suitable forms of FGF21 receptor antigen, including: (1) cell-bound receptor of CHO transfectants expressing full length human FGFR1c and β-Klotho at the cell surface, obtained by transfecting CHO cells with cDNA encoding a human full length FGFR1c polypeptide of SEQ ID NO: 4 (see also FIGS. 1a-b) and cDNA encoding a human β-Klotho polypeptide of SEQ ID NO: 7 (see also FIGS. 2a-c) in a balanced ratio with cells and incubated with FGF21 prior to freezing; (2) cell-bound receptor of 293T transfectants expressing full length human β-Klotho and an N-terminal truncated form of human FGFR1c encompassing amino acid residues 141-822 polypeptide of SEQ ID NO: 4 (D1 domain of FGFR1c deleted).

A suitable amount of immunogen (i.e., 3-4×10$^6$ cells/mouse of stably transfected CHO cells or transiently transfected 293T cells mentioned above was used for initial immunization in XENOMOUSE® according to the methods disclosed in U.S. patent application Ser. No. 08/759,620, filed Dec. 3, 1996 and International Patent Application Nos. WO 98/24893, and WO 00/76310, the disclosures of which are incorporated by reference. Following the initial immunization, subsequent boost immunizations of immunogen (1.7×10$^6$ FGF21R transfected cells/mouse) were administered on a schedule and for the duration necessary to induce a suitable anti-FGF21R titer in the mice. Titers were determined by a suitable method, for example, by enzyme immunoassay, fluorescence activated cell sorting (FACS), or by other methods (including combinations of enzyme immunoassays and FACS).

Animals exhibiting suitable titers were identified, and lymphocytes were obtained from draining lymph nodes and, if necessary, pooled for each cohort. Lymphocytes were dissociated from lymphoid tissue by grinding in a suitable medium (for example, Dulbecco's Modified Eagle Medium; DMEM; obtainable from Invitrogen, Carlsbad, Calif.) to release the cells from the tissues, and suspended in DMEM. B cells were selected and/or expanded using standard methods, and fused with suitable fusion partner, for example, nonsecretory myeloma P3X63Ag8.653 cells (American Type Culture Collection CRL 1580; Kearney et al, (1979) *J. Immunol.* 123:1548-1550), using techniques that were known in the art.

In one suitable fusion method, lymphocytes were mixed with fusion partner cells at a ratio of 1:4. The cell mixture was gently pelleted by centrifugation at 400×g for 4 minutes, the supernatant decanted, and the cell mixture gently mixed (for example, by using a 1 ml pipette). Fusion was induced with PEG/DMSO (polyethylene glycol/dimethyl sulfoxide; obtained from Sigma-Aldrich, St. Louis Mo.; 1 ml per million of lymphocytes). PEG/DMSO was slowly added with gentle agitation over one minute followed, by one minute of mixing. IDMEM (DMEM without glutamine; 2 ml per million of B cells), was then added over 2 minutes with gentle agitation, followed by additional IDMEM (8 ml per million B-cells) which was added over 3 minutes.

The fused cells were pelleted (400×g 6 minutes) and resuspended in 20 ml Selection media (for example, DMEM containing Azaserine and Hypoxanthine [HA] and other supplemental materials as necessary) per million B-cells. Cells were incubated for 20-30 minutes at 37° C. and then resuspended in 200 ml selection media and cultured for three to four days in T175 flasks prior to 96 well plating.

Cells were distributed into 96-well plates using standard techniques to maximize clonality of the resulting colonies. An alternative method was also employed and the fused cells were directly plated clonally into 384-well plates to ensure monoclonality from the start. After several days of culture, supernatants were collected and subjected to screening assays as detailed in the examples below, including confirmation of binding to human FGF21 receptor, specificity and/or cross-species reactivity. Positive cells were further selected and subjected to standard cloning and subcloning techniques. Clonal lines were expanded in vitro, and the secreted human antibodies obtained for analysis.

In this manner, mice were immunized with cells expressing full length FGF21R cells mixed with FGF21, or cells expressing a truncated FGFR1c and full length β-Klotho, with a range of 11-17 immunizations over a period of approximately one to three and one-half months. Several cell lines secreting FGF21R-specific antibodies were obtained, and the antibodies were further characterized. The sequences thereof are presented herein and in the Sequence Listing, and results of various tests using these antibodies are provided.

Example 3

Selection of Binding Antibodies by FMAT

After 14 days of culture, hybridoma supernatants were screened for FGF21R-specific monoclonal antibodies by Fluorometric Microvolume Assay Technology (FMAT) by screening against either the CHO AM1/D/huFGF21R cell line or recombinant HEK293 cells that were transfected with human FGF21R and counter-screening against parental CHO or HEK293 cells. Briefly the cells in Freestyle media (Invitrogen) were seeded into 384-well FMAT plates in a volume of 50 μL/well at a density of 4,000 cells/well for the stable transfectants, and at a density of 16,000 cells/well for the parental cells, and cells were incubated overnight at 37° C. 10 μL/well of supernatant was then added, and the plates were incubated for approximately one hour at 4° C., after which 10 μL/well of anti-human IgG-Cy5 secondary antibody was added at a concentration of 2.8 μg/ml (400 ng/ml final concentration). Plates were then incubated for one hour at 4° C., and fluorescence was read using an FMAT Cellular Detection System (Applied Biosystems).

In total, over 1,500 hybridoma supernatants were identified as binding to the FGF21 receptor expressing cells but not to parental cells by the FMAT method. These supernatants were then tested in the FGF21 functional assays as described below.

Example 4

Selection of Antibodies that Induce FGF21-Like Signaling

Experiments were performed to identify functional antibodies that mimic wild-type FGF21 activity (e.g., the ability to induce FGF21-like signaling) using a suitable FGF21 reporter assay. The disclosed FGF21 reporter assay measures activation of FGFR signaling via a MAPK pathway readout. β-Klotho is a co-receptor for FGF21 signaling, and although it is believed not to have any inherent signaling capability due to its very short cytoplasmic domain, it is required for FGF21 to induce signaling through FGFRs.

Example 4.1

ELK-Luciferase Reporter Assay

ELK-luciferase assays were performed using a recombinant human 293T kidney cell or CHO cell system. Specifically, the host cells were engineered to over-express β-Klotho and luciferase reporter constructs. The reporter constructs contain sequences encoding GAL4-ELK1 and 5×UAS-Luc, a luciferase reporter driven by a promoter containing five tandem copies of the Gal4 binding site. Activation of the FGF21 receptor complex in these recombinant reporter cell lines induces intracellular signal transduction, which in turn leads to ERK and ELK phosphorylation. Luciferase activity is regulated by the level of phosphorylated ELK, and is used to indirectly monitor and quantify FGF21 activity.

In one example, CHO cells were transfected sequentially using the Lipofectamine 2000 transfection reagent (Invitrogen) according to the manufacturer's protocol with the receptor constructs expressing β-Klotho, FGFR1c and the reporter plasmids: 5×Gal4-Luciferase (minimal TK promoter with 5×Gal4 binding sites upstream of luciferase) and Gal4-ELK1. Gal4-ELK1 binds to the Gal4 binding sites and activates transcription when it is phosphorylated by ERK. Luciferase transcription, and thereby the corresponding enzymatic activity in this context is regulated by the level of phosphorylated ELK1, and is used to indirectly monitor and quantify FGF21 activity.

Clone 16 was selected as the FGF21 luciferase reporter cell line based on the optimal assay window of 10-20 fold with native FGF21 exhibiting an EC50 in the single nM range.

For the assay, the ELK-luciferase reporter cells were plated in 96 well assay plates, and serum starved overnight. FGF21 or test samples were added for 6 hours at 37 degrees. The plates were then allowed to cool to room temperature and the luciferase activity in the cell lysates was measured with Bright-Glo (Promega).

Example 4.2

ERK-Phosphorylation Assay

Alternative host cell lines specifically L6 (a rat myoblastic cell line) was developed and applied to identify antibodies with FGF21-like signaling activity. The rat L6 cell line is a desirable host cell line for the activity assay because it is known to express minimal levels of endogeneous FGF receptors. The L6 cells do not respond to FGF21 even when transfected with β-Klotho expression vector and therefore provides a cleaner background. (Kurosu et al., (2007) *J. Biol. Chem.* 282, 26687-26695).

Human primary preadipocytes isolated from subcutaneous adipose tissues of multiple healthy nondiabetic donors were purchased from Zen-Bio, Inc. The preadipocytes were plated in 24-well plates and differentiated for 18 days into mature adipocytes. After a 3-hour starvation period, adipocytes were treated with different concentrations of test molecules for 10 minutes. Following treatment, the media was aspirated and cells were snap-frozen in liquid nitrogen.

Cell lysates were prepared and ERK phosphorylation was measured using the Phospho-ERK1/2(Thr202/Tyr204; Thr185/Tyr187)/Total ERK1/2 Assay Whole Cell Lysate Kit from Meso Scale Discovery.

L6 cells were maintained in Dulbecco's modified Eagle's medium supplemented with 10% fetal bovine serum and penicillin/streptomycin. Cells were transfected with plasmids expressing β-Klotho and individual FGFR using the Lipofectamine 2000 transfection reagent (Invitrogen) according to the manufacturer's protocol.

Analysis of FGF signaling in L6 cells was performed as described in the literature (Kurosu et al., (2007) *J. Biol. Chem.* 282, 26687-26695). Cell cultures were collected 10 min after the treatment of FGF21 or test molecules and snap frozen in liquid nitrogen, homogenized in the lysis buffer and ERK phosphorylation was measured using the Phospho-ERK1/2(Thr202/Tyr204;Thr185/Tyr187)/Total ERK1/2 Assay Whole Cell Lysate Kit from Meso Scale Discovery."

In addition, the factor-dependent mouse BaF3 cell-based proliferation assay used frequently for cytokine receptors can also be developed and applied.

Figure 4:
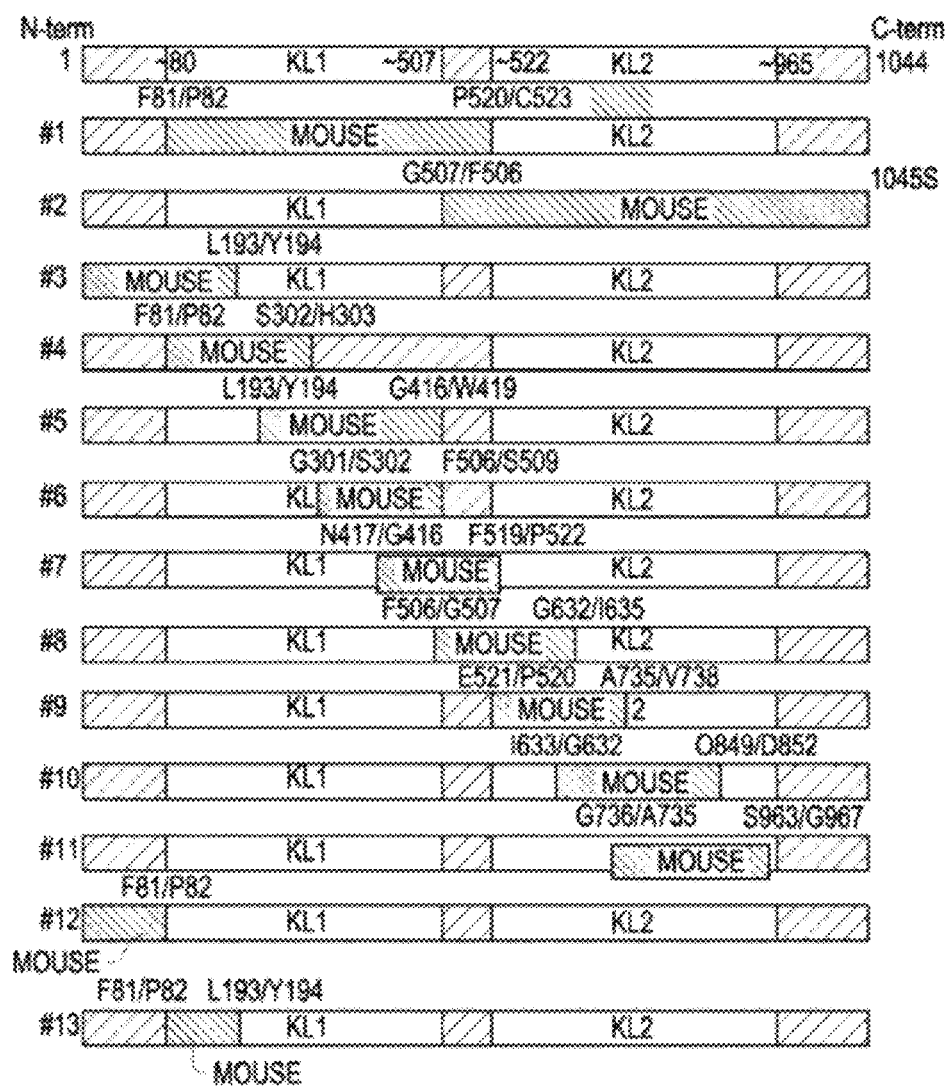
FIG. 4 shows a schematic representation of the chimeras constructed in relation to present invention.

Among the hybridoma supernatants tested in the CHO cell (Clone 16) based human FGF21 ELK-luciferase reporter assay, over 140 were identified as positive (>20% of the activity of FGF21) when compared to 20 nM FGF21 as the positive control (FIGS. 3 and 4). Antibodies can be purified from the conditioned media of the hybridoma cultures of these positives and tested again in the CHO cell based ELK-luciferase reporter assay to assess the potency of the representative antibodies in the dose-responsive assay and determine the EC50. The activities and potency can be confirmed in the L6 cell based ERK1/2-phosphrylation assay. The EC50 is expected to be consistent to the ELK-luciferase assay in the CHO stable cell line Clone 16.

Example 5

Determining that Induction of FGF21-Like Signaling is Specific to the FGFR/βKlotho Complex FGF21 has been reported to signal through multiple receptor complexes including FGFR1c, 2c, 3c, and 4 when paired with β-Klotho. The selectivity of the FGF21 agonistic antibodies can be determined in the rat myoblastic L6 cells transfected with vectors expressing the respective FGFRs and β-Klotho as described in Example 4.2.

Observed selectivity would be strongly suggestive that the action of these antibodies is β-Klotho-dependent yet it must also involve the FGFR component of the signaling complex. The results are set forth in Table 6 below.

TABLE 9

| Molecule | FGFR Selectivity | | | |
|---|---|---|---|---|
| | FGFR1c | FGFR2c | FGFR3c | FGFR4 |
| Fgf21 | + | + | + | − |
| FGF19 | + | + | + | + |
| 16H7 D58A | + | − | − | − |
| 49H12.1 | + | − | − | − |
| 51A8.1 | + | − | − | − |
| 51E5.1 | + | − | − | − |
| 54A1.1 | + | − | − | − |
| 60D7.1 | + | − | − | − |
| 63A10.1 | + | − | − | − |
| 64B10.1 | + | − | − | − |
| 65C3.1 | + | − | − | − |

TABLE 9-continued

| Molecule | FGFR Selectivity | | | |
|---|---|---|---|---|
| | FGFR1c | FGFR2c | FGFR3c | FGFR4 |
| 66G2.1 | + | − | − | − |
| 67F5.1 | + | − | − | − |
| 67C10.1 | + | − | − | − |
| 68C8.1 | + | − | − | − |
| 49C8.1 | + | − | − | − |
| 49G3.3 | + | − | − | − |
| 56E7.3 | + | − | − | − |
| 52A8.1 | + | − | − | − |

Example 5.1

Binding Specificity is Exclusively β-Klotho Dependent

The binding specificity of the reporter assay positive antibodies in the hybridoma supernatants was determined by FACS using 293T cells transiently transfected to express full length FGFR1c alone, β-Klotho alone or FGFR1c and β-Klotho together. Over 98% (141 out of 143 hybridomas) bind β-Klotho alone whereas none bind FGFR1c alone.

Example 6

Activity in Primary Human Adipocytes

FGF21 stimulates glucose uptake and lipolysis in cultured adipocytes, and adipocytes are considered to be more physiologically relevant than the recombinant reporter cell system.

A panel of the antibodies were tested in the human adipocyte assay for Erk-phosphorylation activity as described in Example 4.2 and compared with FGF21 for their $EC_{50}$. The results are set forth below in Table 10 below.

TABLE 10

| Activity of Antibodies on pERK Human Adipocyte Assay | |
|---|---|
| Molecule | $EC_{50}$ |
| Fgf21 | 0.623 |
| 16H7 | 0.280 |
| 49H12.1 | 0.254 |
| 51A8.1 | 0.213 |
| 51E5.1 | 3.221 |
| 54A1.1 | 0.206 |
| 60D7.1 | 0.496 |
| 63A10.1 | 0.435 |
| 64B10.1 | 0.955 |
| 65C3.1 | 6.387 |
| 66G2.1 | 3.529 |
| 67F5.1 | 1.438 |
| 67C10.1 | 5.789 |
| 68C8.1 | 1.216 |
| 49C8.1 | 0.243 |
| 49G3.3 | 1.424 |
| 56E7.3 | 0.916 |
| 58C2.1 | 0.317 |

Example 7

Competition Binding and Epitope Binning

To compare the similarity of the binding sites of the antibodies on the FGF21 receptor, a series of competition binding experiments can be performed and measured by Biacore. In one example, representative agonistic FGF21 receptor antibodies (and any controls) can be immobilized on the sensor chip surface. Soluble human FGFR1c/β-Klotho ECD-Fc complex or β-Klotho can then be captured on the immobilized antibody surfaces. Finally, several of the test FGF21 receptor antibodies can be injected individually over the captured soluble human FGF21 receptor or β-Klotho. If the injected antibody recognizes a distinct binding site relative to that recognized by the immobilized antibody, a second binding event will be observed. If the antibodies recognize very similar binding site, no more binding will be observed.

Alternatively or additionally, a Biacore analysis can be carried out with biotinylated-FGF21 immobilized on the sensor ship. 10 nM soluble β-Klotho is then passed over the chip alone or mixed with the individual test antibodies at 100 nM. The results are set forth below in Table 11 below.

TABLE 11

Epitope Binning Summary

| Bin 1: | $2^{nd}$ Campaign—24H11, 17C3, 16H7, 20D4, 21B4, 22H5, 23F8, 21H2, 18B11; $3^{rd}$ Campaign—40D2, 46D11 Current—49H12, 51A8, 54A1, 60D7, 49C8, 49G3, 56E7, 63A10, 64B10 (*64B10.1*), 67C8, *68C8.1* |
|---|---|
| Bin 2: | $2^{nd}$ Campaign—17D8, 12C11, 26H11, 12E4, 18G1; $3^{rd}$ Campaign—37D3 |
| Bin 3: | $3^{rd}$ Campaign—39F7, 38F2, 39F11, 39G5 |
| Bin 4: | $3^{rd}$ Campaign—20E8 |
| Bin 5: | current—51E5 |
| Bin 6: | current—52A8 (*52A8.1*), 67F5 (*67F5.1*), 67C10 (*67C10.1*), 65C3.1, 66G2.1 |

Bold samples in bold are recombinant mAbs
Italicized samples are from hybridoma supernatants.

Example 8

Recognition of Native and Denatured Structures

The ability of disclosed antigen binding proteins to recognize denatured and native structures was investigated. The procedure and results were as follows.

Example 8.1

FGF21 Receptor Agonistic Antibodies do not Recognize Denatured Structures

Cell lysates from CHO cells stably expressing FGF21 receptor (FGFR1c and β-Klotho) or CHO parental cells were diluted with sample buffer without beta-mercaptoethanol (non-reducing conditions). 20 µl of cell lysate were loaded per lane on adjacent lanes separated with a molecular weight marker lane on 4-20% SDS-PAGE gels. Following electrophoresis, the gels were blotted onto 0.2µ nitrocellulose filters. The blots were treated with Tris-buffered saline/Triton-X (TBST) plus 5% non-fat milk (blocking buffer) for 30 minutes. The blots were then cut along the molecular weight marker lanes. The strips were probed with commercial goat anti-murine βKlotho or mouse anti-huFGFR1 (R&D Diagnostics) in TBST/5% milk. Blots were incubated with the antibodies for one hour at room temperature, followed by three washes with TBST+1% milk. The blots were then probed with anti-human or anti-goat IgG-HRP secondary antibodies for 20 min. Blots were given three 15 minute washes with TBST followed by treatment with Pierce Supersignal West Dura developing reagent (1 minute) and exposure to Kodak Biomax X-ray film.

The commercial anti-β-Klotho and anti-FGFR1 antibodies detected the corresponding receptor proteins in the SDS-PAGE indicating they bind to denatured receptor proteins.

Example 8.2

FGF21 Receptor Agonistic Antibodies Bind to Native Receptor Structure

A FACS binding assay was performed with several commercially available FGFR1c and β-Klotho antibodies, and several of the disclosed FGF21 receptor agonistic antibodies. The experiments were performed as follows.

CHO cells stably expressing FGF21 receptor were treated with R&D Systems mouse anti-huFGFR1, goat anti-mu β-Klotho (1 µg per 1×10$^6$ cells in 100 µl PBS/0.5% BSA). Cells were incubated with the antibodies at 4° C. followed by two washes with PBS/BSA. Cells were then treated with FITC-labeled secondary antibodies at 4° C. followed by two washes. The cells were resuspended in 1 ml PBS/BSA and antibody binding was analyzed using a FACSCalibur™ instrument.

None of the commercial anti-β-Klotho or anti-FGFR1 antibodies tested bind well to cell surface FGF21 receptor, as determined by FACS. This observation further confirmed that the commercial antibodies to the receptor components bind to denatured and non-native structure whereas all of the agonistic antibodies described herein bind receptors on cell surface as shown by FACS or FMAT which were the initial screens.

Example 9

Arginine Scanning

As described above, antigen binding proteins that bind a complex comprising b-Klotho and one of FGFR1c, FGFR2c and FGFR3c can be created and characterized. To determine the neutralizing determinants on human FGFR1c and/or β-Klotho that these various antigen binding proteins bound, a number of mutant FGFR1c and/or β-Klotho proteins can be constructed having arginine substitutions at select amino acid residues of human FGFR1c and/or β-Klotho. Arginine scanning is an art-recognized method of evaluating where antibodies, or other proteins, bind to another protein, see, e.g., Nanevicz et al., (1995) *J. Biol. Chem.*, 270:37, 21619-25 and Zupnick et al., (2006) *J. Biol. Chem.*, 281:29, 20464-73. In general, the arginine sidechain is positively charged and relatively bulky as compared to other amino acids, which can disrupt antibody binding to a region of the antigen where the mutation is introduced. Arginine scanning is a method that determines if a residue is part of a neutralizing determinant and/or an epitope.

Various amino acids distributed throughout the human FGFR1c and/or β-Klotho extracellular domains can be selected for mutation to arginine. The selection can be biased towards charged or polar amino acids to maximize the possibility of the residue being on the surface and reduce the likelihood of the mutation resulting in misfolded protein. Using standard techniques known in the art, sense and anti-sense oligonucleotides containing the mutated residues can be designed based on criteria provided by Stratagene Quickchange® II protocol kit (Stratagene/Agilent, Santa Clara, Calif.). Mutagenesis of the wild-type (WT) FGFR1c and/or β-Klotho sequences can be performed using a Quickchange® II kit (Stratagene). Chimeric constructs can be engineered to encode a FLAG-histidine tag (six histidines (SEQ ID NO: 1830)) on the carboxy terminus of the extracellular domain to facilitate purification via the poly-His tag.

Multiplex analysis using the Bio-Plex Workstation and software (BioRad, Hercules, Calif.) can be performed to determine neutralizing determinants on human FGFR1c and/or β-Klotho by analyzing exemplary human FGFR1c and/or β-Klotho mAbs differential binding to arginine mutants versus wild-type FGFR1c and/or β-Klotho proteins. Any number of bead codes of pentaHis-coated beads ("penta-His" disclosed as SEQ ID NO: 1831) (Qiagen, Valencia, Calif.) can be used to capture histidine-tagged protein. The bead codes can allow the multiplexing of FGFR1c and/or β-Klotho arginine mutants and wild-type human FGFR1c and/or β-Klotho.

To prepare the beads, 100 ul of wild-type FGFR1c and/or β-Klotho and FGFR1c and/or β-Klotho arginine mutant supernatants from transient expression culture are bound to penta-His-coated beads ("penta-His" disclosed as SEQ ID NO: 1831) overnight at 4° C. or 2 hours at room temperature with vigorous shaking. The beads are then washed as per the manufacturer's protocol and the bead set pooled and aliquoted into 2 or 3 columns of a 96-well filter plate (Millipore, Bellerica, Mass., product #MSBVN1250) for duplicate or triplicate assay points, respectively. 100 µl anti-FGFR1c and/or anti-β-Klotho antibodies in 4-fold dilutions are added to the wells, incubated for 1 hour at room temperature, and washed. 100 µl of a 1:100 dilution of PE-conjugated anti-human IgG Fc (Jackson Labs., Bar Harbor, Me.) is added to each well, incubated for 1 hour at room temperature and washed. Beads are resuspended in 1% BSA, shaken for 3 minutes, and read on the Bio-Plex workstation. Antibody binding to FGFR1c and/or β-Klotho arginine mutant protein is compared to antibody binding to the human FGFR1c and/or β-Klotho wild-type from the same pool. A titration of antibody over approximately a 5 log scale can be performed. Median Fluorescence Intensity (MFI) of FGFR1c and/or β-Klotho arginine mutant proteins can be graphed as a percent of maximum wild-type human FGFR1c and/or β-Klotho signal. Those mutants for which signal from all the antibodies are below a cut-off value, e.g., 30% of wild-type FGFR1c and/or β-Klotho can be deemed to be either of too low a protein concentration on the bead due to poor expression in the transient culture or possibly misfolded and can be excluded from analysis. Mutations (i.e., arginine substitutions) that increase the EC50 for the FGFR1c and/or β-Klotho mAb by a cut-off value, e.g., 3-fold or greater (as calculated by, e.g., GraphPad Prism®) can be considered to have negatively affected FGFR1c and/or β-Klotho mAb binding. Through these methods, neutralizing determinants and epitopes for various FGFR1c and/or β-Klotho antibodies are elucidated.

Example 10

Protease Protection Analysis

Regions of the human FGF21 receptor bound by the antigen binding proteins that bind human FGF21 receptor, e.g., FGFR1c, β-Klotho or FGFR1c and β-Klotho complex can be identified by fragmenting human FGF21 receptor into peptides with specific proteases, e.g., AspN, Lys-C, chymotrypsin or trypsin. The sequence of the resulting human FGF21 receptor peptides (i.e., both disulfide- and non-disulfide-containing peptide fragments from FGFR1c and β-Klotho portions) can then be determined. In one example, soluble forms of a human FGF21 receptor, e.g., a complex comprising the FGFR1c ECD-Fc and β-Klotho ECD-Fc heterodimer described herein can be digested with AspN (which cleaves after aspartic acid and some glutamic acid residues at the amino end) by incubating about 100 µg of soluble FGF21 receptor at 1.0 mg/ml in 0.1M sodium phosphate (pH 6.5) for 20 hrs at 37° C. with 2 µg of AspN.

A peptide profile of the AspN digests can then be generated on HPLC chromatography while a control digestion with a similar amount of antibody is expected to be essentially resistant to AspN endoprotease. A protease protection assay can then be performed to determine the proteolytic digestion of human FGF21 receptor in the presence of the antigen binding proteins. The general principle of this assay is that binding of an antigen binding protein to the FGF21 receptor can result in protection of certain specific protease cleavage sites and this information can be used to determine the region or portion of FGF21 receptor where the antigen binding protein binds.

Briefly, the peptide digests can be subjected to HPLC peptide mapping; the individual peaks are collected, and the peptides are identified and mapped by on-line electrospray ionization LC-MS (ESI-LC-MS) analyses and/or by N-terminal sequencing. HPLC analyses for these studies can be performed using a narrow bore reverse-phase C18 column (Agilent Technologies) for off-line analysis and using a capillary reverse phase C18 column (The Separation Group) for LC-MS. HPLC peptide mapping can be performed with a linear gradient from 0.05% trifluoroacetic acid (mobile phase A) to 90% acetonitrile in 0.05% trifluoroacetic acid. Columns can be developed at desirable flow rate for narrow bore HPLC for off-line or on-line LC-MS analyses, and for capillary HPLC for on-line LC-MS analyses.

Sequence analyses can be conducted by on-line LC-MS/MS and by Edman sequencing on the peptide peaks recovered from HPLC. On-line ESI LC-MS analyses of the peptide digest can be performed to determine the precise mass and sequence of the peptides that are separated by HPLC. The identities of selected peptides present in the peptide peaks from the protease digestion can thus be determined.

Example 11

Construction of Chimeric Receptors

An additional method of determining activation determinants on which these various antigen binding proteins bind is as follows. Specific chimeric FGFR1c and/or β-Klotho proteins between human and mouse species can be constructed, expressed in transient or stable 293 or CHO cells (as described herein) and tested. For example, a chimeric FGF21 receptor can be constructed comprising native human FGFR1c, FGFR2c, FGFR3c or FGFR4 receptors. By way of example, FGFR1c can be paired with chimeric human/mouse β-Klotho in which selected regions or sequences on the human β-Klotho are systematically replaced by the corresponding mouse-specific residues (see, e.g., FIG. 2A-2C). Similarly, native human β-Klotho can be paired with chimeric human/mouse FGFR1c, FGFR2c, FGFR3c or FGFR4. Here, selected regions or sequences on the human FGFR1c are systematically replaced by the corresponding mouse-specific residues (see, e.g., the alignments of FIGS. 1A-1B). The critical sequences involved in the binding and/or activity of the antigen binding proteins can be derived through binding assay or activity measurements described in previous Examples 4, 5, 6, and 7 based on the chimeric FGF21 receptors.

Example 11.1 Construction of Specific Chimeras

Human-mouse β-Klotho chimeras were constructed using the methodology described above. A schematic of the chimeras constructed is presented in FIG. 4. In summary, the 25 chimeras generated comprised (from N- to C-terminus) a fusion of a human β-Klotho sequence fused to a murine β-Klotho sequence fused to a human β-Klotho sequence. Human β-Klotho (SEQ ID NO: 7) was used as a framework into which regions of murine β-Klotho (full length sequence shown in SEQ ID NO: 10) were inserted. The regions of murine β-Klotho that were inserted were as follows:

```
Murine Residues 82P-520P
                  (amino acids 82 to 520 of SEQ ID NO: 10)
PKNFSWGVGTGAFQVEGSWKTDGRGPSIWDRYVYSHLRGVNGTDRSTDSY

IFLEKDLLALDFLGVSFYQFSISWPRLFPNGTVAAVNAQGLRYYRALLDS

LVLRNIEPIVTLYHWDLPLTLQEEYGGWKNATMIDLFNDYATYCFQTFGD

RVKYWITIHNPYLVAWHGFGTGMHAPGEKGNLTAVYTVGHNLIKAHSKVW

HNYDKNFRPHQKGWLSITLGSHWIEPNRTDNMEDVINCQHSMSSVLGWFA

NPIHGDGDYPEFMKTGAMIPEFSEAEKEEVRGTADFFAFSFGPNNFRPSN

TVVKMGQNVSLNLRQVLNWIKLEYDDPQILISENGWFTDSYIKTEDTTAI

YMMKNFLNQVLQAIKFDEIRVGFYTAWTLLDGFEWQDAYTTRRGLFYVDF

NSEQKERKPKSSAHYYKQIIQDNGFPLKESTPDMKGRFP

Murine Residues 506F-1043S
                        (amino acids 506 to 1043 of SEQ ID NO: 10)
FPLKESTPDMKGRFPCDFSWGVTESVLKPEFTVSSPQFTDPHLYVWNVTGNR

LLYRVEGVRLKTRPSQCTDYVSIKKRVEMLAKMKVTHYQF ALDWTSILPTGN

LSKVNRQVLRYYRCVVSEGLKLGVFPMVTLYHPTHSHLGLPLPLLSSGGWLN

MNTAKAFQDYAELCFRELGDLVKLWITINEPNRLSDMYNRTSNDTYRAAHN

LMIAHAQVWHL YDRQYRPVQHGAVSLSLHCDWAEPANPFVDSHWKAAERF

LQFEIA WF ADPLFKTGDYPSVMKEYIASKNQRGLSSSVLPRFTAKESRLVKGT

VDFYALNHFTTRFVIHKQLNTNRSVADRDVQFLQDITRLSSPSRLAVTPWGVR

KLLAWIRRNYRDRDIYITANGIDDLALEDDQIRKYYLEKYVQEALKAYLIDK

VKIKGYY AFKLTEEKSKPRFGFFTSDFRAKSSVQFYSKLISSSGLPAENRSPAC

GQPAEDTDCTICSFLVEKKPLIFFGCCFISTLAVLLSITVFHHQKRRKFQKARNL

QNIPLKKGHSRVFS

Murine Residues 1M-193L
                        (amino acids 506 to 1043 of SEQ ID NO: 10)
MKTGCAAGSPGNEWIFFSSDERNTRSRKTMSNRALQRSAVLSAFVLLRAVTG

FSGDGKAIWDKKQYVSPVNPSQLFLYDTFPKNFSWGVGTGAFQVEGSWKTD

GRGPSIWDRYVYSHLRGVNGTDRSTDSYIFLEKDLLALDFLGVSFYQFSISWP

RLFPNGTVAAVNAQGLRYYRALLDSLVLRNIEPIVTL

Murine Residues 82P-302S
                        (amino acids 82 to 302 of SEQ ID NO: 10)
PKNFSWGVGTGAFQVEGSWKTDGRGPSIWDRYVYSHLRGVNGTDRSTDSYI

FLEKDLLALDFLGVSFYQFSISWPRLFPNGTVAAVNAQGLRYYRALLDSLVLR

NIEPNTLYHWDLPLTLQEEYGGWKNATMIDFLNDYATYCFQTFGDRVKYWI

TIHNPYLVAWHGFGTGMHAPGEKGNLTAVYTVGHNLIKAHSKVWHNYDKN

FRPHQKGWLSITLGS
```

-continued

Murine Residues 194Y-416G
                (amino acids 194 to 416 of SEQ ID NO: 10)
YHWDLPLTLQEEYGGWKNATMIDLFNDY ATYCFQTFGDRVKYWITIHNPYL

VAWHGFGTGMHAPGEKGNLTAVYTVGHNLIKAHSKVWHNYDKNFRPHQK

GWLSITLGSHWIEPNRTDNMEDVINCQHSMSSVLGWFANPIHGDGDYPEFMK

TGAMIPEFSEAEKEEVRGTADFFAFSFGPNNFRPSNTVVKMGQNVSLNLRQV

LNWIKLEYDDPQILISENG

Murine Residues 302S-506F
                (amino acids 302 to 506 of SEQ ID NO: 10)
SHWIEPNRTDNMEDVINCQHSMSSVLGWFANPIHGDGDYPEFMKTGAMIPEF

SEAEKEEVRGTADFFAFSFGPNNFRPSNTVVKMGQNVSLNLRQVLNWIKLEY

DDPQILISENGWFTDSYIKTEDTTAIYMMKNFLNQVLQAIKFDEIRVFGYTAW

TLLDGFEWQDAYTTRRGLFYVDFNSEQKERKPKSSAHYYKQIIQDNGF

Murine Residues 416G-519P
                (amino acids 416 to 519 of SEQ ID NO: 10)
GWFTDSYIKTEDTTAIYMMKNFLNQVLQAIKFDEIRVFGYTAWTLLDGFEWQ

DAYTTRRGLFYVDFNSEQKERKPKSSAHYYKQIIQDNGFPLKESTPDMKGRF

Murine Residues 507P-632G
                (amino acids 507 to 632 of SEQ ID NO: 10)
PLKESTPDMKGRFPCDFSWGVTESVLKPEFTVSSPQFTDPHLYVWNVTGNRL

LYRVEGVRLKTRPSQCTDYVSIKKRVEMLAKMKVTHYQFALDWTSILPTGNL

SKVNRQVLRYYRCVVSEGLKLG

Murine Residues 520P-735A
                (amino acids 520 to 735 of SEQ ID NO: 10)
PCDFSWGVTESVLKPEFTVSSPQFTDPHLYVWNVTGNRLLYRVEGVRLKTRP

SQCTDYVSIKKRVEMLAKMKVTHYQFALDWTSILPTGNLSKVNRQVLRYYR

CVVSEGLKLGVFPMVTLYHPTHSHLGLPLPLLSSGGWLNMNTAKAFQDYAE

LCFRELGDLVKLWITINEPNRLSDMYNRTSNDTYRAAHNLMIAHAQVWHLY

DRQYRPVQHGA

Murine Residues 632G-849Q
                (amino acids 632 to 849 of SEQ ID NO: 10)
GVFPMVTLYHPTHSHLGLPLPLLSSGGWLNMNTAKAFQDYAELCFRELGDL

VKLWITINEPNRLSDMYNRTSNDTYRAAHNLMIAHAQVWHLYDRQYRPVQH

GAVSLSLHCDWAEPANPFVDSHWKAAERFLQFEIAWFADPLFKTGDYPSVM

KEYIASKNQRGLSSSVLPRFTAKESRLVKGTVDFYALNHFTTRFVIHKQLNTN

RSVADRDVQFLQ

Murine Residues 735A-963S
                (amino acids 735 to 963 of SEQ ID NO: 10)
AVSLSLHCDWAEPANPFVDSHWKAAERFLQFEIAWFADPLFKTGDYPSVMK

EYIASKNQRGLSSSVLPRFTAKESRLVKGTVDFYALNHFTTRFVIHKQLNTNR

SVADRDVQFLQDITRLSSPSRLAVTPWGVRKLLAWIRRNYRDRDIYITANGID

DLALEDDQIRKYYLEKYVQEALKAYLIDKVKIKGYYAFKLTEEKSKPRFGFFT

SDFRAKSSVQFYSKLISSS

Murine Residues 1M-81F
                    (amino acids 1 to 81 of SEQ ID NO: 10)
MKTGCAAGSPGNEWIFFSSDERNTRSRKTMSNRALQRSA VLSAFVLLRA VTG

FSGDGKAIWDKKQYVSPVNPSQLFL YDTF

-continued

Murine Residues 82P-193L
        (amino acids 82 to 193 of SEQ ID NO: 10)
PKNFSWGVGTGAFQVEGSWKTDGRGPSIWDRYVYSHLRGVNGTDRSTDSYI

FLEKDLLALDFLGVSFYQFSISWPRLFPNGTV AA VNAQGLRYYRALLDSLVLR

NIEPNTL

The chimeras that were generated using the murine β-Klotho sequences comprised the following:

TABLE 12

| Construct | Construct Identifier | SEQ. ID NO. | N-terminal Human β-Klotho Residues | Mouse β-Klotho Residues | C-terminal Human β-Klotho Residues |
|---|---|---|---|---|---|
| 1 | huBeta_Klotho (1-81, 523-1044) (muBetaKLOTHO 82-520) | | 1-81 | 82-520 | 523-1044 |
| 2 | huBeta_Klotho (1-507) (muBetaKLOTHO 506F-1045S) | | 1-507 | 506-1043 | |
| 3 | huBeta_Klotho (194-1044) (muBetaKLOTHO 1-L193) | | | 1-193 | 194-1044 |
| 4 | huBeta_Klotho (1-81, 303-1044) (muBetaKLOTHO 82P-302S) | | 1-81 | 82-302 | 303-1044 |
| 5 | huBeta_Klotho (1-193, 419-1044) (muBetaKLOTHO Y194-416G) | | 1-193 | 194-416 | 419-1044 |
| 6 | huBeta_Klotho(1-301, 509-1044) (muBetaKLOTHO S302-F506) | | 1-301 | 302-506 | 509-1044 |
| 7 | huBeta_Klotho(1-417, 522-1044) (muBetaKLOTHO G416-F519) | | 1-417 | 416-519 | 522-1044 |
| 8 | huBeta_Klotho (1-507, 635-1044) (muBeta KLOTHO F06-G632) | | 1-508 | 507-632 | 635-1044 |
| 9 | huBeta_Klotho (1-521, 738-1044) (muBeta KLOTHO 520P-735A) | | 1-521 | 520-735 | 738-1044 |
| 10 | huBeta_Klotho (1-633, 852-1044) (muBeta KLOTHO 632G-849Q) | | 1-633 | 632-849 | 852-1044 |
| 11 | huBeta_Klotho (1-736, 967-1044) (muBeta KLOTHO 735A-963S) | | 1-736 | 735-963 | 967-1044 |
| 12 | huBeta_Klotho (82-1044) (muBeta KLOTHO 1-81F) | | | 1-81 | 82-1044 |
| 13 | huBeta_Klotho (1-81, 194-1044) (muBeta KLOTHO 82P-193L) | | 1-81 | 82-193 | 194-1044 |
| 14 | huBeta_Klotho (1-301, 509-743, 967-1044) (muBeta KLOTHO 302-506, 742-964) | | 1-301 | 302-506, 742-964 | 967-1044 |

The generated chimeras comprised the following amino acid sequences:

(i) huBeta_Klotho(1-81, 523-1044)
    (muBetaKLOTHO 82-520)
                                   (SEQ ID NO: 1898)
MKPGCAAGSPGNEWIFFSTDEITTRYRNTMSNGGLQRSVILSALILLRA V

TGFSGDGRAIWSKNPNFTPVNESQLFL YDTFPKNFSWGVGTGAFQVEGSW

KTDGRGPSIWDRYVYSHLRGVNGTDRSTDSYIFLEKDLLALDFLGVSFYQ

FSISWPRLFPNGTVAAVNAQGLRYYRALLDSLVLRNIEPIVTLYHWDLPL

TLQEEYGGWKNATMIDLFNDYATYCFQTFGDRVKYWITIHNPYLVAWHGF

GTGMHAPGEKGNLTAVYTVGHNLIKAHSKVWHNYDKNFRPHQKGWLSITL

GSHWIEPNRTDNMEDVINCQHSMSSVLGWFANPIHGDGDYPEFMKTGAMI

PEFSEAEKEEVRGTADFFAFSFGPNNFRPSNTVVKMGQNVSLNLRQVLNW

IKLEYDDPQILISENGWFTDSYIKTEDTTAIYMMKNFLNQVLQAIKFDEI

RVFGYTAWTLLDGFEWQDA YTTRRGLFYVDFNSEQKERKPKSSAHYYKQI

IQDNGFPLKESTPDMKGRFPCDFSWGVTESVLKPESVASSPQFSDPHLYV

WNATGNRLLHRVEGVRLKTRPAQCTDFVNIKKQLEMLARMKVTHYRFALD

WASVLPTGNLSA VNRQALRYYRCVVSEGLKLGISAMVTLYYPTHAHLGLP

EPLLHADGWLNPSTAEAFQAYAGLCFQELGDLVKLWITINEPNRLSDIYN

RSGNDTYGAAHNLLVAHALA WRL YDQQFRPSQRGA VSLSLHADWAE-
PANP

YADSHWRAAERFLQFEIA WF AEPLFKTGDYPAAM-
REYIASKHRRGLSSSA

LPRLTEAERRLLKGTVDFCALNHFTTRFVMHEQLAGSRYDSDRDIQFLQD

ITRLSSPTRLA VIPWGVRKLLRWVRRNYGDMDIYITASGIDDQALEDDRL

RKYYLGKYLQEVLKA YLIDKVRIKGYY AFKLAEEKSKPRFGFFTSD-
FKAK

SSIQFYNKVISSRGFPFENSSSRCSQTQENTECTVCLFL VQKKPLIFLGC

CFFSTL VLLLSIAIFQRQKRRKFWKAKNLQHIPLKKGKRVVS (ii) huBeta_Klotho(1-507)
     (muBetaKLOTHO 506F-1045S)
                                   (SEQ ID NO: 1899)
MKPGCAAGSPGNEWIFFSTDEITTRYRNTMSNGGLQRSVILSALILLRAV

TGFSGDGRAIWSKNPNFTPVNESQLFL YDTFPKNFFWGIGTGALQVEGSW

KKDGKGPSIWDHFIHTHLKNVSSTNGSSDSYIFLEKDLSALDFIGVSFYQ

FSISWPRLFPDGIVTV ANAKGLQYYSTLLDALVLRNIEPIVTLYHWDLPL

ALQEKYGGWKNDTIIDIFNDYATYCFQMFGDRVKYWITIHNPYLVA WHGY

GTGMHAPGEKGNLAA VYTVGHNLIKAHSKVWHNYNTHFRPHQKGWLSITL

GSHWIEPNRSENTMDIFKCQQSMVSVLGWF ANPIHGDGDYPEGMRKKLFS

VLPIFSEAEKHEMRGTADFF AFSFGPNNFKPLNTMAKMGQNVSLNLREAL

NWIKLEYNNPRILIAENGWFTDSRVKTEDTTAIYMMKNFLSQVLQAIRLD

EIRVFGYTA WSLLDGFEWQDA YTIRRGLFYVDFNSKQKERKPKS-
SAHYYK

-continued

QIIRENGFPLKESTPDMKGRFPCDFSWGVTESVLKPEFTVSSPQFTDPHL
YVWNVTGNRLL YRVEGVRLKTRPSQCTDYVSIKKRVEMLAKMKVTHYQFA
LDWTSILPTGNLSKVNRQVLRYYRCVVSEGLKLGVFPMVTLYHPTHSHLG
LPLPLLSSGGWLNMNTAKAFQDYAELCFRELGDLVKLWITINEPNRLSDM
YNRTSNDTYRAAHNLMIAHAQVWHLYDRQYRPVQHGAVSLSLHCDWAEPA
NPFVDSHWKAAERFLQFEIAWFADPLFKTGDYPSVMKEYIASKNQRGLSS
SVLPRFTAKESRLVKGTVDFYALNHFTTRFVIHKQLNTNRSVADRDVQFL
QDITRLSSPSRLAVTPWGVRKLLAWIRRNYRDRDIYITANGIDDLAEDD
QIRKYYLEKYVQEALKAYLIDKVKIKGYYAFKLTEEKSKPRFGFFTSDFR
AKSSVQFYSKLISSSGLPAENRSPACGQPAEDTDCTICSFLVEKKPLIFF
GCCFISTLAVLLSITVPHHQKRRKFQKARNLQNIPLKKGHSRVFS (iii) huBeta_Klotho(194-1044)
(muBetaKLOTHO 1-L193)
(SEQ ID NO: 1900)
MKTGCAAGSPGNEWIFFSSDERNTRSRKTMSNRALQRSA VLLSAFVLLRAV
TGFSGDGKAIWDKKQYVSPVNPSQLFLYDTFPKNFSWGVGTGAFQVEGSW
KTDGRGPSIWDRYVYSHLRGVNGTDRSTDSYIFLEKDLLALDFLGVSFYQ
FSISWPRLFPNGTVAAVNAQGLRYYRALLDSLVLRNIEPIVTLYHWDLPL
ALQEKYGGWKNDTIIDIFNDYATYCFQMFGDRVKYWITIHNPYLVAWHGY
GTGMHAPGEKGNLAAVYTVGHNLIKAHSKVWHNYNTHFRPHQKGWLSITL
GSHWIEPNRSENTMDIFKCQQSMVSVLGWFANPIHGDGDYPEGMRKKLFS
VLPIFSEAEKHEMRGTADFFAFSFGPNNFKPLNTMAKMGQNVSLNLREAL
NWIKLEYNNPRILIAENGWFTDSRVKTEDTTAIYMMKNFLSQVLQAIRLD
EIRVFGYTAWSLLDGFEWQDAYTIRRGLFYVDFNSKQKERKPKSSAHYYK
QIIRENGFSLKESTPDVQGQFPCDFSWGVTESVLKPESVASSPQFSDPHL
YVWNATGNRLLHRVEGVRLKTRPAQCTDFVNIKKQLEMLARMKVTHYRFA
LDWASVLPTGNLSAVNRQALRYYRCVVSEGLKLGISAMVTLYYPTHAHLG
LPEPLLHADGWLNPSTAEAFQAYAGLCFQELGDLVKLWITINEPNRLSDI
YNRSGNDTYGAAHNLLVAHALAWRLYDQQFRPSQRGAVSLSLHADWAEPA
NPYADSHWRAAERFLQFEIAWFAEPLFKTGDYPAAMREYIASKHRRGLSS
SALPRLTEAERRLLKGTVDFCALNHFTTRFVMHEQLAGSRYDSDRDIQFL
QDITRLSSPTRLAVIPWGVRKLLRWVRRNYGDMDIYITASGIDDQALEDD
RLRKYYLGKYLQEVLKAYLIDKVRIKGYYAFKLAEEKSKPRFGFFTSDFK
AKSSIQFYNKVISSRGFPFENSSSRCSQTQENTECTVCLFLVQKKPLIFL
GCCFFSTLVLLLSIAIFQRQKRRKFWKAKNLQHIPLKKGKRVVS (iv) huBeta_Klotho(1-81, 303-1044)
(muBetaKLOTHO 82P-302S)
(SEQ ID NO: 1901)
MKPGCAAGSPGNEWIFFSTDEITTRYRNTMSNGGLQRSVILSALILLRAV
TGFSGDGRAIWSKNPNFTPVNESQLFLYDTFPKNFSWGVGTGAFQVEGSW
KTDGRGPSIWDRYVYSHLRGVNGTDRSTDSYIFLEKDLLALDFLGVSFYQ
FSISWPRLFPNGTVAAVNAQGLRYYRALLDSLVLRNIEPIVTLYHWDLPL
TLQEEYGGWKNATMIDLFNDYATYCFQTFGDRVKYWITIHNPYLVAWHGF GTGMHAPGEKGNLTAVYTVGHNLIKAHSKVWHNYDKNFRPHQKGWLSITL
GSHWIEPNRSENTMDIFKCQQSMVSVLGWFANPIHGDGDYPEGMRKKLFS
VLPIFSEAEKHEMRGTADFF AFSFGPNNFKPLNTMAKMGQNVSLNLREAL
NWIKLEYNNPRILIAENGWFTDSRVKTEDTTAIYMMKNFLSQVLQAIRLD
EIRVFGYTAWSLLDGFEWQDA YTIRRGLFYVDFNSKQKERKPKSSAHYYK
QIIRENGFSLKESTPDVQGQFPCDFSWGVTESVLKPESV ASSPQFSDPHL
YVWNATGNRLLHRVEGVRLKTRPAQCTDFVNIKKQLEMLARMKVTHYRFA
LDWASVLPTGNLSAVNRQALRYYRCVVSEGLKLGISAMVTLYYPTHAHLG
LPEPLLHADGWLNPSTAEAFQAYAGLCFQELGDLVKLWITINEPNRLSDI
YNRSGNDTYGAAHNLLVAHALAWRLYDQQFRPSQRGAVSLSLHADWAEPA
NPYADSHWRAAERFLQFEIAWFAEPLFKTGDYPAAMREYIASKHRRGLSS
SALPRLTEAERRLLKGTVDFCALNHFTTRFVMHEQLAGSRYDSDRDIQFL
QDITRLSSPTRLAVIPWGVRKLLRWVRRNYGDMDIYITASGIDDQALEDD
RLRKYYLGKYLQEVLKAYLIDKVRIKGYYAFKLAEEKSKPRFGFFTSDFK
AKSSIQFYNKVISSRGFPFENSSSRCSQTQENTECTVCLFLVQKKPLIFL
GCCFFSTLVLLLSIAIFQRQKRRKFWKAKNLQHIPLKKGKRVVS (v) huBeta_Klotho(1-193, 419-1044)
(muBetaKLOTHO Y194-416G)
(SEQ ID NO: 1902)
MKPGCAAGSPGNEWIFFSTDEITTRYRNTMSNGGLQRSVILSALILLRA V
TGFSGDGRAIWSKNPNFTPVNESQLFL YDTFPKNFFWGIGTGALQVEGSW
KKDGKGPSIWDHFIHTHLKNVSSTNGSSDSYIFLEKDLSALDFIGVSFYQ
FSISWPRLFPDGIVTV ANAKGLQYYSTLLDALVLRNIEPIVTLYHWDLPL
TLQEEYGGWKNATMIDLFNDY ATYCFQTFGDRVKYWITIHN-
PYLVA WHGF GTGMHAPGEKGNLTA VYTVGHNLIKAHSKVWHNYDKNFRPHQKGWLSITL
GSHWIEPNRTDNMEDVINCQHSMSSVLGWFANPIHGDGDYPEFMKTGAMI
PEFSEAEKEEVRGTADFFAFSFGPNNFRPSNTVVKMGQNVSLNLRQVLNW
IKLEYDDPQILISENGWFTDSRVKTEDTTAIYMMKNFLSQVLQAIRLDEI
RVFGYTAWSLLDGFEWQDAYTIRRGLFYVDFNSKQKERKPKSSAHYYKQI
IRENGFSLKESTPDVQGQFPCDFSWGVTESVLKPESVASSPQFSDPHLYV
WNATGNRLLHRVEGVRLKTRPAQCTDFVNIKKQLEMLARMKVTHYRFALD
WASVLPTGNLSAVNRQALRYYRCVVSEGLKLGISAMVTLYYPTHAHLGLP
EPLLHADGWLNPSTAEAFQAYAGLCFQELGDLVKLWITINEPNRLSDIYN
RSGNDTYGAAHNLLVAHALAWRLYDQQFRPSQRGAVSLSLHADWAEPANP
YADSHWRAAERFLQFEIAWFAEPLFKTGDYPAAMREYIASKHRRGLSSSA
LPRLTEAERRLLKGTVDFCALNHFTTRFVMHEQLAGSRYDSDRDIQFLQD
ITRLSSPTRLAVIPWGVRKLLRWVRRNYGDMDIYITASGIDDQALEDDRL
RKYYLGKYLQEVLKAYLIDKVRIKGYYAFKLAEEKSKPRFGFFTSDFKAK
SSIQFYNKVISSRGFPFENSSSRCSQTQENTECTVCLFLVQKKPLIFLGC
CFFSTLVLLLSIAIFQRQKRRKFWKAKNLQHIPLKKGKRVVS (vi) huBeta_Klotho(1-301, 509-1044)
(muBetaKLOTHO S302-F506)

(SEQ ID NO: 1903)
MKPGCAAGSPGNEWIFFSTDEITTRYRNTMSNGGLQRSVILSALILLRAV
TGFSGDGRAIWSKNPNFTPVNESQLFLYDTFPKNFFWGIGTGALQVEGSW
KKDGKGPSIWDHFIHTHLKNVSSTNGSSDSYIFLEKDLSALDFIGVSFYQ
FSISWPRLFPDGIVTVANAKGLQYYSTLLDALVLRNIEPIVTLYHWDLPL
ALQEKYGGWKNDTIIDIFNDYATYCFQMFGDRVKYWITIHNPYLVAWHGY
GTGMHAPGEKGNLAAVYTVGHNLIKAHSKVWHNYNTHFRPHQKGWLSITL
GSHWIEPNRTDNMEDVINCQHSMSSVLGWFANPIHGDGDYPEFMKTGAMI
PEFSEAEKEEVRGTADFFAFSFGPNNFRPSNTVVKMGQNVSLNLRQVLNW
IKLEYDDDPQILISENGWFTDSYIKTEDTTAIYMMKNFLNQVLQAIKFDEI
RVFGYTAWTLLDGFEWQDAYTTRRGLFYVDFNSEQKERKPKSSAHYYKQI
IQDNGFSLKESTPDVQGQFPCDFSWGVTESVLKPESVASSPQFSDPHLYV
WNATGNRLLHRVEGVRLKTRPAQCTDFVNIKKQLEMLARMKVTHYRFALD
WASVLPTGNLSAVNRQALRYYRCVVSEGLKLGISAMVTLYYPTHAHGLGLP
EPLLHADGWLNPSTAEAFQAYAGLCFQELGDLVKLWITINEPNRLSDIYN
RSGNDTYGAAHNLLVAHALAWRLYDQQFRPSQRGAVSLSLHADWAEPANP
YADSHWRAAERFLQFEIAWFAEPLFKTGDYPAAMREYIASKHRRGLSSSA
LPRLTEAERRLLKGTVDFCALNHFTTRFVMHEQLAGSRYDSDRDIQFLQD
ITRLSSPTRLAVIPWGVRKLLRWVRRNYGDMDIYITASGIDDQALEDDRL
RKYYLGKYLQEVLKAYLIDKVRIKGYYAFKLAEEKSKPRFGFFTSDFKAK
SSIQFYNKVISSRGFPFENSSSRCSQTQENTECTVCLFLVQKKPLIFLGC
CFFSTLVLLLSIAIFQRQKRRKFWKAKNLQHIPLKKGKRVVS (vii) huBeta_Klotho(1-417, 522-1044)
(muBetaKLOTHO G416-F519)

(SEQ ID NO: 1904)
MKPGCAAGSPGNEWIFFSTDEITTRYRNTMSNGGLQRSVILSALILLRAV
TGFSGDGRAIWSKNPNFTPVNESQLFLYDTFPKNFFWGIGTGALQVEGSW
KKDGKGPSIWDHFIHTHLKNVSSTNGSSDSYIFLEKDLSALDFIGVSFYQ
FSISWPRLFPDGIVTVANAKGLQYYSTLLDALVLRNIEPIVTLYHWDLPL
ALQEKYGGWKNDTIIDIFNDYATYCFQMFGDRVKYWITIHNPYLVA WHGY
GTGMHAPGEKGNLAAVYTVGHNLIKAHSKVWHNYNTHFRPHQKGWLSITL
GSHWIEPNRSENTMDIFKCQQSMVSVLGWFANPIHGDGDYPEGMRKKLFS
VLPIFSEAEKHEMRGTADFFAFSFGPNNFKPLNTMAKMGQNVSLNLREAL
NWIKLEYNNPRILIAENGWFTDSYIKTEDTTAIYMMKNFLNQVLQAIKFD
EIRVFGYTAWTLLDGFEWQDAYTTRRGLFYVDFNSEQKERKPKSSAHYYK
QIIQDNGFPLKESTPDMKGRFPCDFSWGVTESVLKPESVASSPQFSDPHL
YVWNATGNRLLHRVEGVRLKTRPAQCTDFVNIKKQLEMLARMKVTHYRFA
LDWASVLPTGNLSAVNRQALRYYRCVVSEGLKLGISAMVTLYYPTHAHGLG
LPEPLLHADGWLNPSTAEAFQAYAGLCFQELGDLVKLWITINEPNRLSDI
YNRSGNDTYGAAHNLLVAHALAWRLYDQQFRPSQRGAVSLSLHADWAEPA
NPYADSHWRAAERFLQFEIAWFAEPLFKTGDYPAAMREYIASKHRRGLSS
SALPRLTEAERRLLKGTVDFCALNHFTTRFVMHEQLAGSRYDSDRDIQFL
QDITRLSSPTRLAVIPWGVRKLLRWVRRNYGDMDIYITASGIDDQALEDD
RLRKYYLGKYLQEVLKAYLIDKVRIKGYYAFKLAEEKSKPRFGFFTSDFK
AKSSIQFYNKVISSRGFPFENSSSRCSQTQENTECTVCLFLVQKKPLIFL
GCCFFSTLVLLLSIAIFQRQKRRKFWKAKNLQHIPLKKGKRVVS (viii) huBeta_Klotho(1-507, 635-1044)
(muBeta KLOTHO F06-G632)

(SEQ ID NO: 1905)
MKPGCAAGSPGNEWIFFSTDEITTRYRNTMSNGGLQRSVILSALILLRA V
TGFSGDGRAIWSKNPNFTPVNESQLFLYDTFPKNFFWGIGTGALQVEGSW
KKDGKGPSIWDHFIHTHLKNVSSTNGSSDSYIFLEKDLSALDFIGVSFYQ
FSISWPRLFPDGIVTV ANAKGLQYYSTLLDALVLRNIEPIVTLYHWDLPL
ALQEKYGGWKNDTIIDIFNDYATYCFQMFGDRVKYWITIHNPYLVAWHGY
GTGMHAPGEKGNLAAVYTVGHNLIKAHSKVWHNYNTHFRPHQKGWLSITL
GSHWIEPNRSENTMDIFKCQQSMVSVLGWF ANPIHGDGDYPEGMRKKLFS
VLPIFSEAEKHEMRGTADFF AFSFGPNNFKPLNTMAKMGQNVSLNLREAL
NWIKLEYNNPRILIAENGWFTDSRVKTEDTTAIYMMKNFLSQVLQAIRLD
EIRVFGYTA WSLLDGFEWQDA YTIRRGLFYVDFNSKQKERKPKS-SAHYYK
QIIRENGFPLKESTPDMKGRFPCDFSWGVTESVLKPEFTVSSPQFTDPHL
YVWNVTGNRLLYRVEGVRLKTRPSQCTDYVSIKKRVEMLAKMKVTHYQFA
LDWTSILPTGNLSKVNRQVLRYYRCVVSEGLKLGISAMVTLYYPTHAHLG
LPEPLLHADGWLNPSTAEAFQAYAGLCFQELGDLVKLWITINEPNRLSDI
YNRSGNDTYGAAHNLLVAHALAWRLYDQQFRPSQRGAVSLSLHADWAEPA
NPYADSHWRAAERFLQFEIAWFAEPLFKTGDYPAAMREYIASKHRRGLSS
SALPRLTEAERRLLKGTVDFCALNHFTTRFVMHEQLAGSRYDSDRDIQFL
QDITRLSSPTRLAVIPWGVRKLLRWVRRNYGDMDIYITASGIDDQALEDD
RLRKYYLGKYLQEVLKAYLIDKVRIKGYYAFKLAEEKSKPRFGFFTSDFK
AKSSIQFYNKVISSRGFPFENSSSRCSQTQENTECTVCLFLVQKKPLIFL
GCCFFSTLVLLLSIAIFQRQKRRKFWKAKNLQHIPLKKGKRVVS (ix) huBeta_Klotho(1-521, 738-1044)
(muBeta KLOTHO 520P-735A)

(SEQ ID NO: 1906)
MKPGCAAGSPGNEWIFFSTDEITTRYRNTMSNGGLQRSVILSALILLRA V
TGFSGDGRAIWSKNPNFTPVNESQLFL YDTFPKNFFWGIGTGALQVEGSW
KKDGKGPSIWDHFIHTHLKNVSSTNGSSDSYIFLEKDLSALDFIGVSFYQ
FSISWPRLFPDGIVTVANAKGLQYYSTLLDALVLRNIEPIVTLYHWDLPL
ALQEKYGGWKNDTIIDIFNDYATYCFQMFGDRVKYWITIHNPYLVAWHGY
GTGMHAPGEKGNLAAVYTVGHNLIKAHSKVWHNYNTHFRPHQKGWLSITL
GSHWIEPNRSENTMDIFKCQQSMVSVLGWFANPIHGDGDYPEGMRKKLFS
VLPIFSEAEKHEMRGTADFF AFSFGPNNFKPLNTMAKMGQNVSLNLREAL
NWIKLEYNNPRILIAENGWFTDSRVKTEDTTAIYMMKNFLSQVLQAIRLD
EIRVFGYTA WSLLDGFEWQDAYTIRRGLFYVDFNSKQKERKPKSSAHYYK
QIIRENGFSLKESTPDVQGQFPCDFSWGVTESVLKPEFTVSSPQFTDPHL
YVWNVTGNRLLYRVEGVRLKTRPSQCTDYVSIKKRVEMLAKMKVTHYQFA

```
LDWTSILPTGNLSKVNRQVLRYYRCVVSEGLKLGVFPMVTLYHPTHSHLG
LPLPLLSSGGWLNMNTAKAFQDYAELCFRELGDLVKLWITINEPNRLSDM
YNRTSNDTYRAAHNLMIAHAQVWHLYDRQYRPVQHGAVSLSLHADWAEPA
NPYADSHWRAAERFLQFEIAWFAEPLFKTGDYPAAMREYIASKHRRGLSS
SALPRLTEAERRLLKGTVDFCALNHFTTRFVMHEQLAGSRYDSDRDIQFL
QDITRLSSPTRLAVIPWGVRKLLRWVRRNYGDMDIYITASGIDDQALEDD
RLRKYYLGKYLQEVLKAYLIDKVRIKGYYAFKLAEEKSKPRFGFFTSDFK
AKSSIQFYNKVISSRGFPFENSSSRCSQTQENTECTVCLFLVQKKPLIFL
GCCFFSTLVLLLSIAIFQRQKRRKFWKAKNLQHIPLKKGKRVVS (x) huBeta_Klotho(1-633, 852-1044)
(muBeta KLOTHO 632G-849Q)
                                    (SEQ ID NO: 1907)
MKPGCAAGSPGNEWIFFSTDEITTRYRNTMSNGGLQRSVILSALILLRA V
TGFSGDGRAIWSKNPNFTPVNESQLFLYDTFPKNFFWGIGTGALQVEGSW
KKDGKGPSIWDHFIHTHLKNVSSTNGSSDSYIFLEKDLSALDFIGVSFYQ
FSISWPRLFPDGIVTV ANAKGLQYYSTLLDALVLRNIEPIVTLYHWDLPL
ALQEKYGGWKNDTIIDIFNDYATYCFQMFGDRVKYWITIHNPYLVAWHGY
GTGMHAPGEKGNLAAVYTVGHNLIKAHSKVWHNYNTHFRPHQKGWLSITL
GSHWIEPNRSENTMDIFKCQQSMVSVLGWFANPIHGDGDYPEGMRKKLFS
VLPIFSEAEKHEMRGTADFF AFSFGPNNFKPLNTMAKMGQNVSLNLREAL
NWIKLEYNNPRILIAENGWFTDSRVKTEDTTAIYMMKNFLSQVLQAIRLD
EIRVFGYTAWSLLDGFEWQDAYTIRRGLFYVDFNSKQKERKPKSSAHYYK
QIIRENGFSLKESTPDVQGQFPCDFSWGVTESVLKPESV ASSPQFSDPHL
YVWNATGNRLLHREVGVRLKTRPAQCTDFVNIKKQLEMLARMKVTHYRF A
LDWASVLPTGNLSAVNRQALRYYRCVVSEGLKLGVFPMVTLYHPTHSHLG
LPLPLLSSGGWLNMNTAKAFQDYAELCFRELGDLVKLWITINEPNRLSDM
YNRTSNDTYRAAHNLMIAHAQVWHLYDRQYRPVQHGAVSLSLHCDWAEPA
NPFVDSHWKAAERFLQFEIAWFADPLFKTGDYPSVMKEYIASKNQRGLSS
SVLPRFTAKESRLVKGTVDFYALNHFTTRFVIHKQLNTNRSVADRDVQFL
QDITRLSSPTRLAVIPWGVRKLLRWVRRNYGDMDIYITASGIDDQALEDD
RLRKYYLGKYLQEVLKAYLIDKVRIKGYYAFKLAEEKSKPRFGFFTSDFK
AKSSIQFYNKVISSRGFPFENSSSRCSQTQENTECTVCLFLVQKKPLIFL
GCCFFSTLVLLLSIAIFQRQKRRKFWKAKNLQHIPLKKGKRVVS (xi) huBeta_Klotho(1-736, 967-1044)
(muBeta KLOTHO 735A-963S)
                                    (SEQ ID NO: 1908)
MKPGCAAGSPGNEWIFFSTDEITTRYRNTMSNGGLQRSVILSALILLRAV
TGFSGDGRAIWSKNPNFTPVNESQLFLYDTFPKNFFWGIGTGALQVEGSW
KKDGKGPSIWDHFIHTHLKNVSSTNGSSDSYIFLEKDLSALDFIGVSFYQ
FSISWPRLFPDGIVTVANAKGLQYYSTLLDALVLRNIEPIVTLYHWDLPL
ALQEKYGGWKNDTIIDIFNDYATYCFQMFGDRVKYWITIHNPYLVAWHGY
GTGMHAPGEKGNLAAVYTVGHNLIKAHSKVWHNYNTHFRPHQKGWLSITL
GSHWIEPNRSENTMDIFKCQQSMVSVLGWFANPIHGDGDYPEGMRKKLFS
VLPIFSEAEKHEMRGTADFF AFSFGPNNFKPLNTMAKMGQNVSLNLREAL
NWIKLEYNNPRILIAENGWFTDSRVKTEDTTAIYMMKNFLSQVLQAIRLD
EIRVFGYTA WSLLDGFEWQDA YTIRRGLFYVDFNSKQKERKPKS-
SAHYYK
QIIRENGFSLKESTPDVQGQFPCDFSWGVTESVLKPESVASSPQFSDPHL
YVWNATGNRLLHREVGVRLKTRPAQCTDFVNIKKQLEMLARMKVTHYRFA
LDWASVLPTGNLSAVNRQALRYYRCVVSEGLKLGISAMVTLYYPTHAHLG
LPEPLLHADGWLNPSTAEAFQAYAGLCFQELGDLVKLWITINEPNRLSDI
YNRSGNDTYGAAHNLLVAHALAWRLYDQQFRPSQRGAVSLSLHCDWAEPA
NPFVDSHWKAAERFLQFEIAWFADPLFKTGDYPSVMKEYIASKNQRGLSS
SVLPRFTAKESRLVKGTVDFYALNHFTTRFVIHKQLNTNRSVADRDVQFL
QDITRLSSPSRLAVTPWGVRKLLAWIRRNYRDRDIYITANGIDDALEDD
QIRKYYLEKYVQEALKAYLIDKVKIKGYYAFKLTEEKSKPRFGFFTSDFR
AKSSVQFYSKLISSSGFPFENSSSRCSQTQENTECTVCLFLVQKKPLIFL
GCCFFSTLVLLLSIAIFQRQKRRKFWKAKNLQHIPLKKGKRVVS (xii) huBeta Klotho(82-1044)
(muBeta KLOTHO 1-81F)
                                    (SEQ ID NO: 1909)
MKTGCAAGSPGNEWIFFSSDERNTRSRKTMSNRALQRSAVLSAFVLLRAV
TGFSGDGKAIWDKKQYVSPVNPSQLFLYDTFPKNFFWGIGTGALQVEGSW
KKDGKGPSIWDHFIHTHLKNVSSTNGSSDSYIFLEKDLSALDFIGVSFYQ
FSISWPRLFPDGIVTVANAKGLQYYSTLLDALVLRNIEPIVTLYHWDLPL
ALQEKYGGWKNDTIIDIFNDYATYCFQMFGDRVKYWITIHNPYLVAWHGY
GTGMHAPGEKGNLAAVYTVGHNLIKAHSKVWHNYNTHFRPHQKGWLSITL
GSHWIEPNRSENTMDIFKCQQSMVSVLGWFANPIHGDGDYPEGMRKKLFS
VLPIFSEAEKHEMRGTADFFAFSFGPNNFKPLNTMAKMGQNVSLNLREAL
NWIKLEYNNPRILIAENGWFTDSRVKTEDTTAIYMMKNFLSQVLQAIRLD
EIRVFGYTA WSLLDGFEWQDAYTIRRGLFYVDFNSKQKERKPKSSAHYYK
QIIRENGFSLKESTPDVQGQFPCDFSWGVTESVLKPESVASSPQFSDPHL
YVWNATGNRLLHREVGVRLKTRPAQCTDFVNIKKQLEMLARMKVTHYRFA
LDWASVLPTGNLSAVNRQALRYYRCVVSEGLKLGISAMVTLYYPTHAHLG
LPEPLLHADGWLNPSTAEAFQAYAGLCFQELGDLVKLWITINEPNRLSDI
YNRSGNDTYGAAHNLLVAHALAWRLYDQQFRPSQRGAVSLSLHADWAEPA
NPYADSHWRAAERFLQFEIAWFAEPLFKTGDYPAAMREYIASKHRRGLSS
SALPRLTEAERRLLKGTVDFCALNHFTTRFVMHEQLAGSRYDSDRDIQFL
QDITRLSSPTRLAVIPWGVRKLLRWVRRNYGDMDIYITASGIDDQALEDD
RLRKYYLGKYLQEVLKAYLIDKVRIKGYYAFKLAEEKSKPRFGFFTSDFK
AKSSIQFYNKVISSRGFPFENSSSRCSQTQENTECTVCLFLVQKKPLIFL
GCCFFSTLVLLLSIAIFQRQKRRKFWKAKNLQHIPLKKGKRVVS (xiii) huBeta_Klotho(1-81, 194-1044)
(muBeta KLOTHO 82P-193L)
                                    (SEQ ID NO: 1910)
MKPGCAAGSPGNEWIFFSTDEITTRYRNTMSNGGLQRSVILSALILLRAV
TGFSGDGRAIWSKNPNFTPVNESQLFLYDTFPKNFSWGVGTGAFQVEGSW
KTDGRGPSIWDRYVYSHLRGVNGTDRSTDSYIFLEKDLLALDFLGVSFYQ
```

-continued
FSISWPRLFPNGTVAAVNAQGLRYYRALLDSLVLRNIEPIVTLYHWDLPL

ALQEKYGGWKNDTIIDIFNDYATYCFQMFGDRVKYWITIHNPYLVA WHGY

GTGMHAPGEKGNLAAVYTVGHNLIKAHSKVWHNYNTHFRPHQKGWLSITL

GSHWIEPNRSENTMDIFKCQQSMVSVLGWFANPIHGDGDYPEGMRKKLFS

VLPIFSEAEKHEMRGTADFF AFSFGPNNFKPLNTMAKMGQNVSLNLREAL

NWIKLEYNNPRILIAENGWFTDSRVKTEDTTAIYMMKNFLSQVLQAIRLD

EIRVFGYTA WSLLDGFEWQDA YTIRRGLFYVDFNSKQKERKPKS-
SAHYYK

QIIRENGFSLKESTPDVQGQFPCDFSWGVTESVLKPESVASSPQFSDPHL

YVWNATGNRLLHRVEGVRLKTRPAQCTDFVNIKKQLEMLARMKVTHYRFA

LDWASVLPTGNLSAVNRQALRYYRCVVSEGLKLGISAMVTLYYPTHAHLG

LPEPLLHADGWLNPSTAEAFQAYAGLCFQELGDLVKLWITINEPNRLSDI

YNRSGNDTYGAAHNLLVAHALAWRLYDQQFRPSQRGAVSLSLHADWAEPA

NPYADSHWRAAERFLQFEIAWFAEPLFKTGDYPAAMREYIASKHRRGLSS

SALPRLTEAERRLLKGTVDFCALNHFTTRFVMHEQLAGSRYDSDRDIQFL

QDITRLSSPTRLAVIPWGVRKLLRWVRRNYGDMDIYITASGIDDQALEDD

RLRKYYLGKYLQEVLKAYLIDKVRIKGYYAFKLAEEKSKPRFGFFTSDFK

AKSSIQFYNKVISSRGFPFENSSSRCSQTQENTECTVCLFLVQKKPLIFL

GCCFFSTLVLLLSIAIFQRQKRRKFWKAKNLQHIPLKKGKRVVS (xiv) huBeta_Klotho (1-301, 509-743, 967-1044)
(muBetaKLOTHO 302-506, 742-964)
(SEQ ID NO: 1911)
MKPGCAAGSPGNEWIFFSTDEITTRYRNTMSNGGLQRSVILSALILLRA V

TGFSGDGRAIWSKNPNFTPVNESQLFL YDTFPKNFFWGIGTGALQVEGSW

KKDGKGPSIWDHFIHTHLKNVSSTNGSSDSYIFLEKDLSALDFIGVSFYQ

FSISWPRLFPDGIVTV ANAKGLQYYSTLLDALVLRNIEPIVTLYHWDLPL

ALQEKYGGWKNDTIIDIFNDYATYCFQMFGDRVKYWITIHNPYLVAWHGY

GTGMHAPGEKGNLAAVYTVGHNLIKAHSKVWHNYNTHFRPHQKGWLSITL

GSHWIEPNRTDNMEDVINCQHSMSSVLGWF ANPIHGDGDYPEFMKTGAMI

PEFSEAEKEEVRGTADFFAFSFGPNNFRPSNTVVKMGQNVSLNLRQVLNW

IKLEYDDPQILISENGWFTDSYIKTEDTTAIYMMKNFLNQVLQAIKFDEI

RVFGYTA WTLLDGFEWQDAYTTRRGLFYVDFNSEQKERKPKSSAHYYKQI

IQDNGFSLKESTPDVQGQFPCDFSWGVTESVLKPESV ASSPQFSDPHLYV

WNATGNRLLHRVEGVRLKTRPAQCTDFVNIKKQLEMLARMKVTHYRFALD

W ASVLPTGNLSA VNRQALRYYRCVVSEGLKLGISAMVTLYYPTHAHL-
GLP

EPLLHADGWLNPSTAEAFQAYAGLCFQELGDLVKLWITINEPNRLSDIYN

RSGNDTYGAAHNLLVAHALAWRLYDQQFRPSQRGAVSLSLHCDWAEPANP

FVDSHWKAAERFLQFEIAWFADPLFKTGDYPSVMKEYIASKNQRGLSSSV

LPRFTAKESRLVKGTVDFYALNHFTTRFVIHKQLNTNRSVADRDVQFLQD

ITRLSSPSRLAVTPWGVRKLLAWIRRNYRDRDIYITANGIDDLALEDDQI

RKYYLEKYVQEALKAYLIDKVKIKGYYAFKLTEEKSKPRFGFFTSDFRAK

-continued
SSVQFYSKLISSSGFPFENSSSRCSQTQENTECTVCLFLVQKKPLIFLGC

CFFSTLVLLLSIAIFQRQKRRKFWKAKNLQHIPLKKGKRVVS

Figure 5:
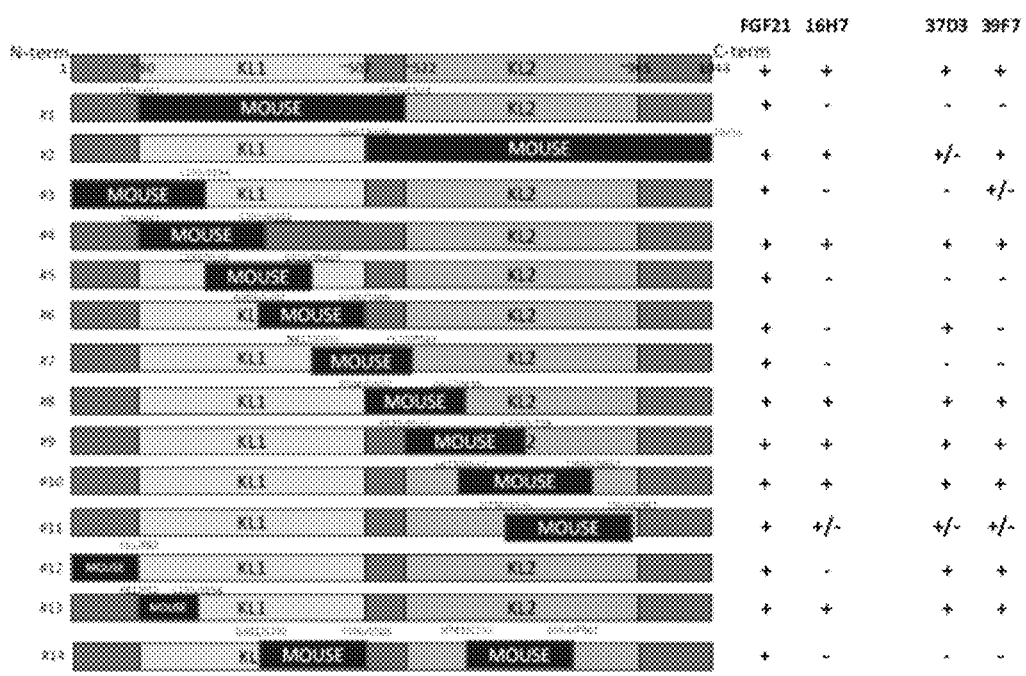
FIG. 5 shows the ability of the antigen binding proteins, as well as human FGF21, to activate chimeras in L6 cells.
Figure 6A:
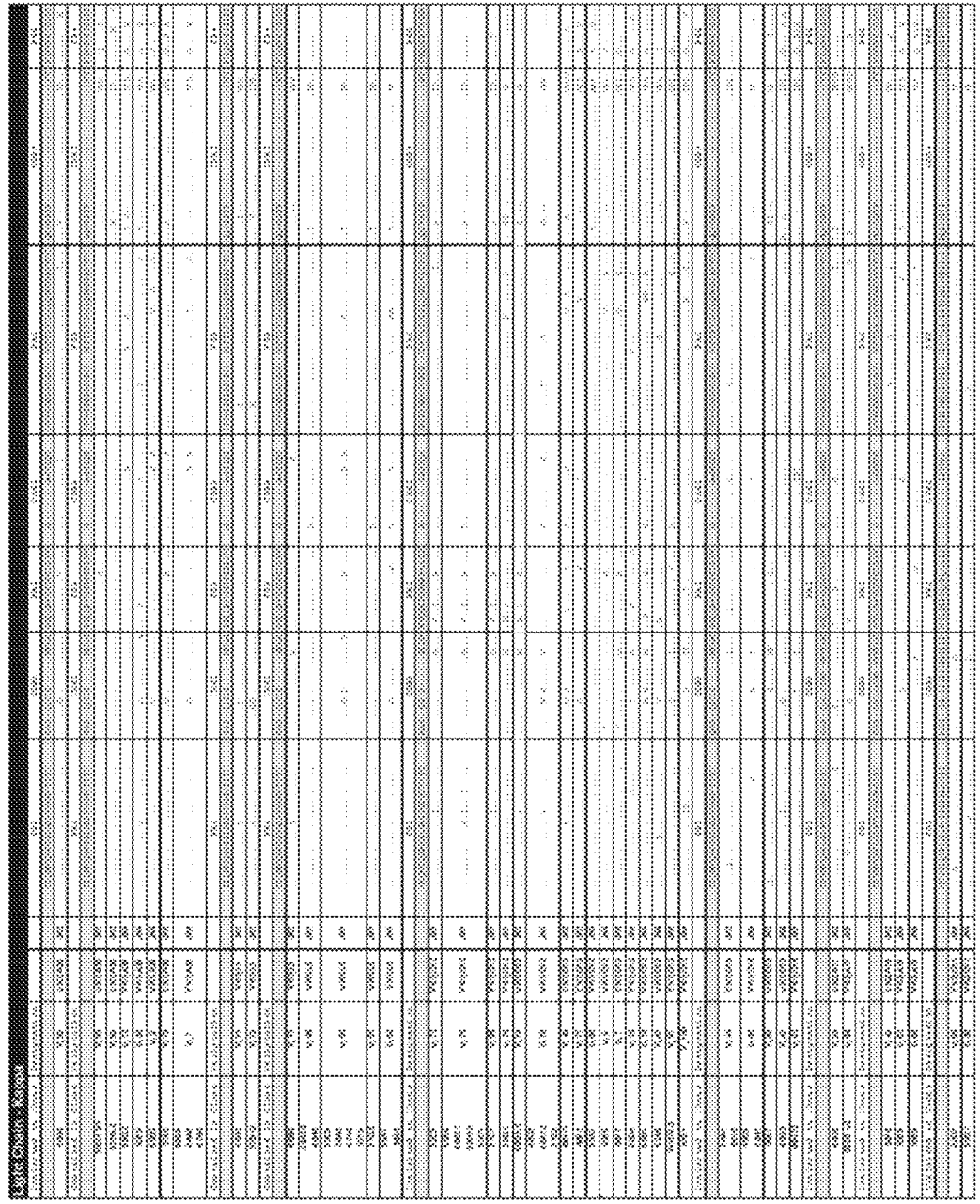
Figure 6B:
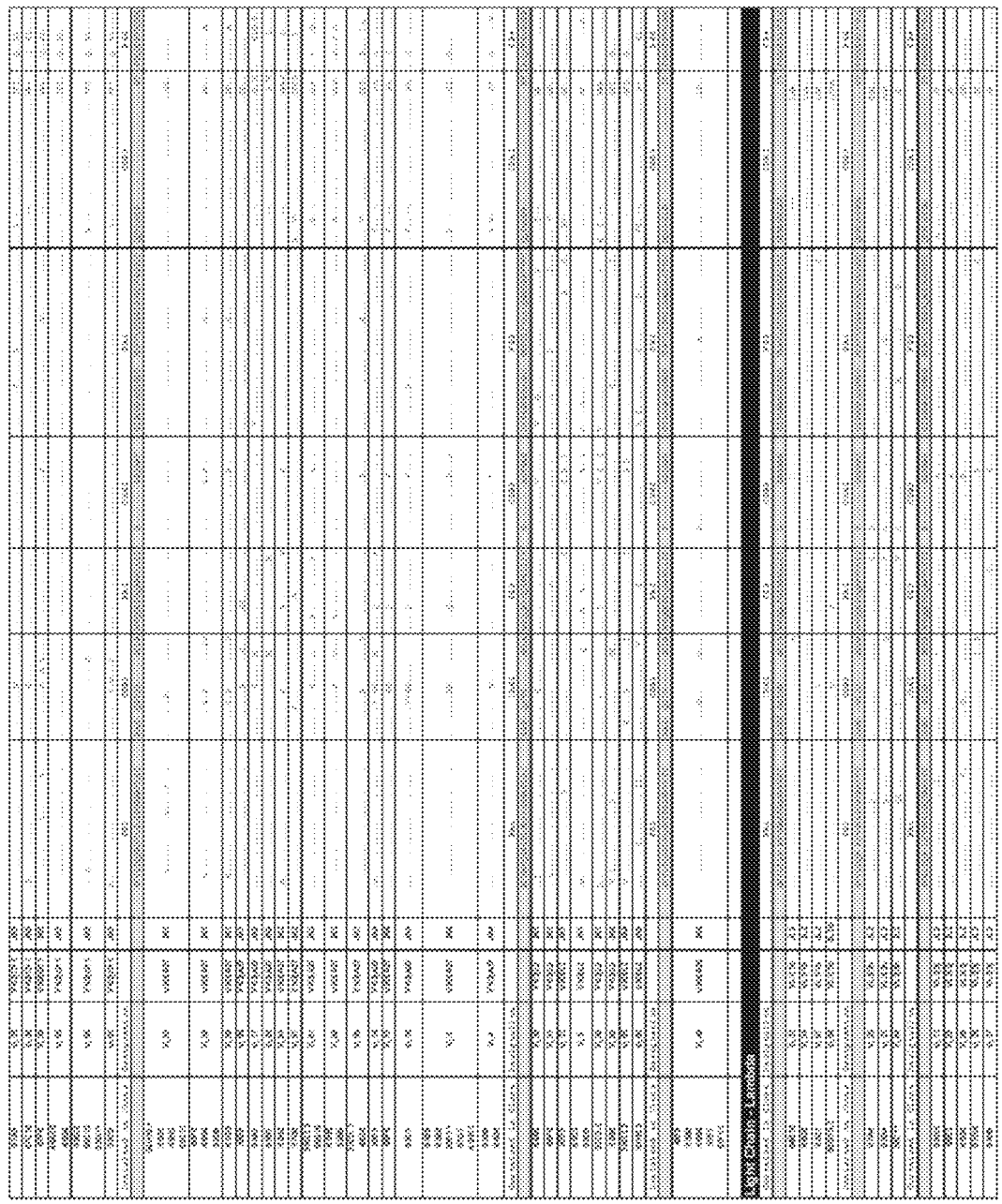
Figure 6C:
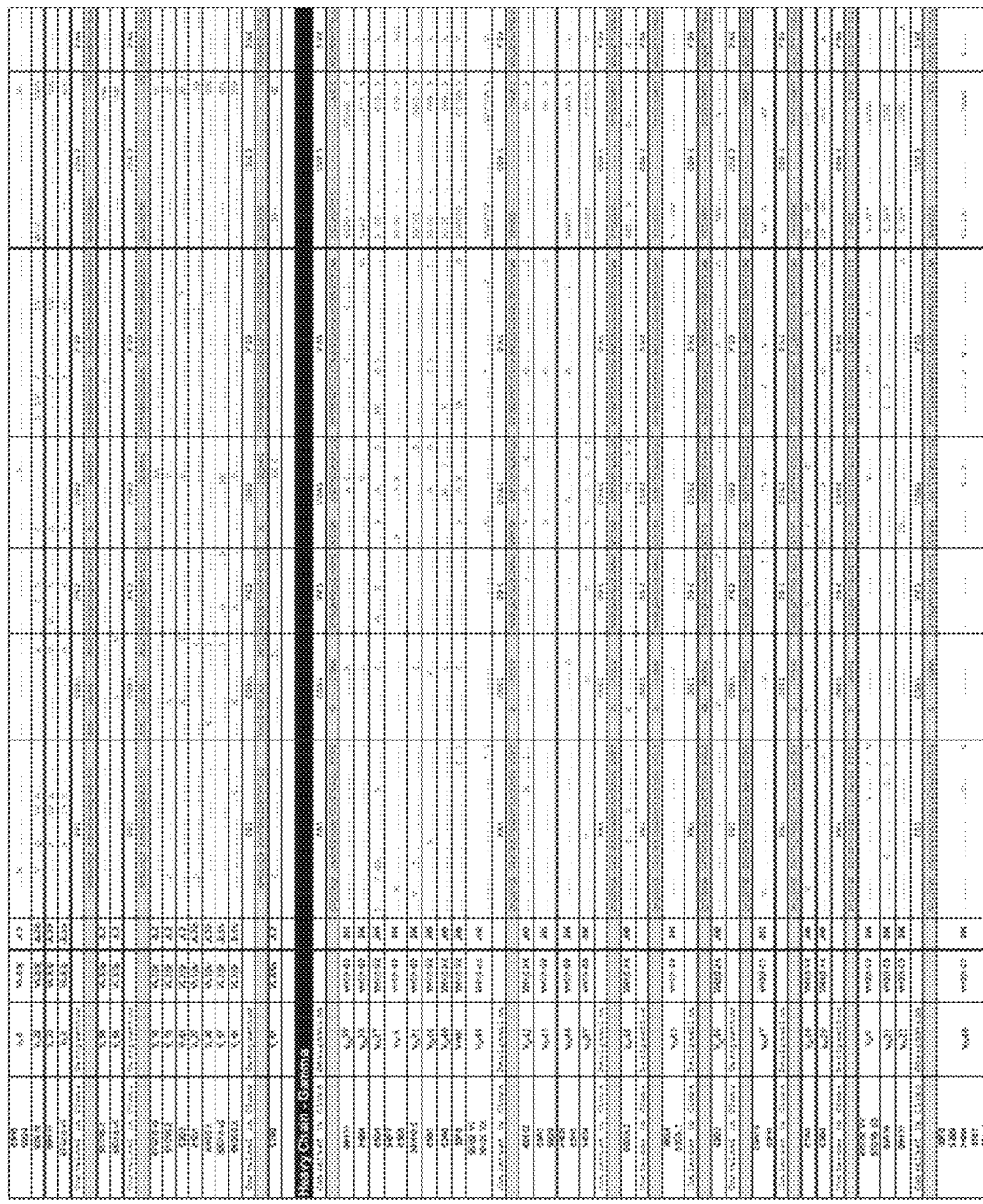

Various antigen binding proteins provided herein, as well as human FGF21, were tested for the ability to activate chimeras in L6 cells. FIG. 5 shows the observed results with each tested molecule.

These data indicate that while human FGF21 was able to activate FGFR1c combined with all of the human/mouse β-Klotho chimeras (the "+" sign indicates activity on the receptor), the substitutions of mouse sequences into human β-Klotho affected the activities of 16H7, 37D3, and 39F7 (See FIG. 5). These results suggest that β-Klotho sequences 1-81, 302-522, and 849-1044 are important for the activities of agonistic antigen binding proteins and may represent an important epitope for their function.

In addition, various antigen binding proteins were also tested for binding to the various human/mouse β-Klotho chimeras transiently expressed on the surface of HEK-293T cells by flow cytometry. Transfection and flow-cytometry was performed as described in Example 12. It will be appreciated that antibodies which do not have the ability to cross-bind full length murine β-Klotho are unable to bind the human/mouse β-Klotho chimera if the chimera spans a region of the antibody's binding site. In this manner, the binding profile of each antibody on the panel of chimeras reveals epitope information for the antibody. Data is shown below in Table 10. The anti-β-Klotho antibody 2G10 (which binds both human and mouse β-Klotho) was used as the positive control for expression of each human/mouse chimera. Using this positive control it was determine the expression level of chimeras 7 and 8 were not high enough to provide robust data and therefore they were eliminated from the analysis. One antibody, 26H11, was found to bind to full-length mouse β-Klotho and therefore could not be assigned an epitope in this analysis. Other antibodies which did not cross-bind to mouse β-Klotho could be group into epitope clusters. The first cluster included antibodies 16H7, 46D11, and 49G3.3, which antibodies did not bind to chimera #3 and chimera #12, indicating that the epitope includes the 1-81 region. Additionally, this group of antibodies also lacked observed binding to chimeras 1, 5, 6 and 14, which indicates that the epitope also includes the 294-506 region. Taken together, this data suggests that these antibodies have a complex non-linear type of epitope.

A second cluster included only antibody 65C3.1. This antibody lacked binding to chimeras #2, #11, and #14, indicating an epitope in the region of 849-936. A third cluster, including antibodies 49H12.1, 54A1.1, 49C8.1, 51A8.1, 63A10.1, 64B10.1, 68C8.1 and 39F7, lacked binding to chimera #1, #5, and #6, indicating that their epitope is in the 302-416 region. The forth cluster included antibodies 67C10.1, 51E5.1, 52A8.1, 66G2, 167F5.1, which lacked binding on chimeras #2, #8, #9, #10, #11, and #14 indicating that the epitope for these antibodies lies within region 506-1045. A "+" or "−" symbol in the chart below indicates binding of the respective antibody ("+"), or lack of binding ("−") to the chimera and/or the respective ortholog of β-Klotho, or Mock Cells (negative control).

TABLE 13

Chimera Binding

| | CHIMERA # | | | | | | | | | | | | hu β-Klotho | mu β-klotho | Mock cells (Neg. Cont.) | Epitope Region |
|---|---|---|---|---|---|---|---|---|---|---|---|---|---|---|---|---|
| | 1 | 2 | 3 | 4 | 5 | 6 | 9 | 10 | 11 | 12 | 13 | 14 | | | | |
| 2G10 | + | + | + | + | + | + | + | + | + | + | + | + | + | + | − | |
| 26H11 | + | + | + | + | + | + | + | + | + | + | + | + | + | + | − | |
| 16H7 | − | + | − | + | − | − | + | + | + | − | + | − | + | − | − | 1-81 & |
| 49G3.3 | − | + | − | + | − | − | + | + | + | − | + | − | + | − | − | 302-416 |
| 46D11 | − | + | − | + | − | − | + | + | + | − | + | − | + | − | − | |
| 49H12.1 | − | + | + | + | − | − | + | + | + | + | + | − | + | − | − | 302-416 |
| 54A1.1 | − | + | + | + | − | − | + | + | + | + | + | − | + | − | − | |
| 49C8.1 | − | + | + | + | − | − | + | + | + | + | + | − | + | − | − | |
| 51A8.1 | − | + | + | + | − | − | + | + | + | + | + | − | + | − | − | |
| 63A10.1 | − | + | + | + | − | − | + | + | + | + | + | − | + | − | − | |
| 64B10.1 | − | + | + | + | − | − | + | + | + | + | + | − | + | − | − | |
| 68C8.1 | − | + | + | + | − | − | + | + | + | + | + | − | + | − | − | |
| 39F7 | − | + | + | + | − | − | + | + | + | + | + | − | + | − | − | |
| 65C3.1 | + | − | + | + | + | + | + | + | − | + | + | − | + | − | − | 849-936 |
| 67C10.1 | + | − | + | + | + | + | − | − | − | + | + | − | + | − | − | 506-1045 |
| 51E5.1 | + | − | + | + | + | + | − | − | − | + | + | − | + | − | − | |
| 52A8.1 | + | − | + | + | + | + | − | − | − | + | + | − | + | − | − | |
| 66G2.1 | + | − | + | + | + | + | − | − | − | + | + | − | + | − | − | |
| 67F5.1 | + | − | + | + | + | + | − | − | − | + | + | − | + | − | − | |
| IgG2/K Control | − | − | − | − | − | − | − | − | − | − | − | − | − | − | − | |
| IgG4/K Control | − | − | − | − | − | − | − | − | − | − | − | − | − | − | − | |
| Secondary Only | − | − | − | − | − | − | − | − | − | − | − | − | − | − | − | |

Example 12

FGF21 Receptor Agonistic Antibodies Binding Selectivity

A panel of FGF21 receptor agonistic antibodies were assayed using flow cytometry for the binding to human FGFR1/human β-klotho transiently co-transfected HEK293T cells, human FGFR1c transiently transfected HEK293T cells and β-klotho transiently transfected HEK293T cells. In addition, binding was also tested on HEK-293T cells transiently transfected with cynomologous monkey orthologs of FGFR1c and β-klotho. Cells were transfected by preparing 10 ug plasmid DNA in 500 µl OptiMEM™ media (Invitrogen™) and mixing this with 10 ul of 293Fectin™ in 500 µl OptiMEM™ media, and then incubating the solution for 5 minutes at room temperature. This solution was then added dropwise to 10 million HEK293T cells in 10 ml of media. 24 hours following transfection, the cells were washed and 50,000 cells were stained with each primary antibody, 50 µl of unpurified hybridoma supernatant was diluted 1:2 and used for staining cells. After a one hour incubation at 4° c., the cells were washed and an anti-Human Fc-specific secondary was added. Stained cells were then analyzed on a flow cytometerz. The panel of hybridoma supernatants tested all bound specifically to human β-Klotho/human FGFR1c co-transfected cells as well as human β-Klotho transfected alone. Data is shown below in Table 11. No staining was detected for any of the antibodies on cells transfected with FGFR1c alone. All antibodies except 64B10.1 and 68C8.1 specifically detected cynomologous β-Klotho/cynoFGFR1c co-transfected cells.

TABLE 14

FGFR Antibody Selectivity

| Antibody | Mock Transfected 293T cells GeoMean | Human FGFR1c Transfect 293T cells GeoMean | Human β-Klotho Tranfected 293T Cells GeoMean | HuFGFR1c/Hu β-Klotho Co-transfected 293T Cells GeoMean | Cyno FGFR1c/Cyno β-Klotho Co-transfected Cells GeoMean |
|---|---|---|---|---|---|
| 49G3.3 | 648 | 706 | 14891 | 17919 | 25947 |
| 49H12.1 | 581 | 719 | 16213 | 21731 | 20870 |
| 51E5.1 | 723 | 747 | 16900 | 20951 | 36536 |
| 51A8.1 | 728 | 795 | 17799 | 22826 | 18476 |
| 54A1.1 | 709 | 770 | 14317 | 18701 | 11106 |
| 59G10.3 | 686 | 780 | 15669 | 21105 | 33464 |
| 63A10.1 | 648 | 834 | 17442 | 20432 | 32558 |
| 64B10.1 | 624 | 691 | 14939 | 19850 | 701 |
| 65C3.1 | 705 | 719 | 13720 | 18835 | 24564 |
| 66G2.1 | 695 | 780 | 12671 | 16715 | 21566 |
| 67F5.1 | 632 | 757 | 13482 | 13948 | 15784 |
| 67C10.1 | 688 | 780 | 15114 | 18896 | 4063 |

TABLE 14-continued

FGFR Antibody Selectivity

| Antibody | Mock Transfected 293T cells GeoMean | Human FGFR1c Transfect 293T cells GeoMean | Human β-Klotho Tranfected 293T Cells GeoMean | HuFGFR1c/Hu β-Klotho Co-transfected 293T Cells GeoMean | Cyno FGFR1c/Cyno β-Klotho Co-transfected Cells GeoMean |
|---|---|---|---|---|---|
| 68C8.1 | 592 | 798 | 15905 | 20622 | 750 |
| 16H7 @ 5 ug/ml | 723 | 869 | 16335 | 20686 | 31319 |

Example 13

Hotspot/Covariant Mutants

A total of 17 antibodies were analyzed for potential hotspots and covariance violations. The designed variants (shown below) outline amino acid substitutions capable of reducing and/or avoiding isomerization, deamidation, oxidation, covariance violations, and the like. In the data below, "02 49C8.1_VKL[F21I]" refers to a variant of the parental antibody 49C8.1 that has a mutation at position 21, from F (Phe) to I (Isoleucine). Note that a structure-based numbering scheme is followed for designating amino acid positions. It will be appreciated that these single point mutations can be combined in any combinatorial manner in order to arrive at a final desired molecule. The data are shown below in Table 15 and Table 16.

TABLE 15

| | Antibody 49C8.1 |
|---|---|
| 02 | 49C8.1_VK: [F21I] |
| 03 | 49C8.1_VK: [F91L] |
| 04 | 49C8.1_VK: [I101F] |
| 05 | 49C8.1_VK: [I101V] |
| 06 | 49C8.1_VK: [P141Q] |
| 07 | 49C8.1_VK: [P141G] |
| 08 | 49C8.1_VH: [T48P] |
| 09 | 49C8.1_VH: [N61Q] |
| 10 | 49C8.1_VH: [G65T] |
| | Antibody 49H12_N83D |
| 01 | 49H12_N83D_VK: [F91L] |
| 02 | 49H12_N83D_VK: [I101F] |
| 03 | 49H12_N83D_VK: [I101V] |
| 04 | 49H12_N83D_VH: [M24K] |
| 05 | 49H12_N83D_VH: [I30T] |
| 06 | 49H12_N83D_VH: [T48P] |
| 07 | 49H12_N83D_VH: [W57Y] |
| 08 | 49H12_N83D_VH: [W111Y] |
| | Antibody 49G3.3 |
| 01 | 49G3.3_VK: [F91L] |
| 02 | 49G3.3_VK: [I101F] |
| 03 | 49G3.3_VK: [I101V] |
| 04 | 49G3.3_VK: [G141Q] |
| 05 | 49G3.3_VH: [E17Q] |
| 06 | 49G3.3_VH: [V25F] |
| 07 | 49G3.3_VH: [T56A] |
| 08 | 49G3.3_VH: [T56G] |
| 09 | 49G3.3_VH: [T144L] |
| 10 | 49G3.3_VH: [T144M] |
| | Antibody 51A8.1 |
| 01 | 51A8.1_VL: [I98T] |
| 02 | 51A8.1_VL: [I98A] |
| 03 | 51A8.1_VH: [R17G] |
| 04 | 51A8.1_VH: [D61E] |
| 05 | 51A8.1_VH: [D72E] |
| 06 | 51A8.1_VH: [D110E] |

TABLE 15-continued

| | Antibody 51E5.1 |
|---|---|
| 01 | 51E5.1_VK: [N53K] |
| 02 | 51E5.1_VK: [R54L] |
| 03 | 51E5.1_VK: [R54S] |
| 04 | 51E5.1_VK: [G141Q] |
| 05 | 51E5.1_VH: [D59E] |
| 06 | 51E5.1_VH: [H60T] |
| | Antibody 52A8.1 |
| 01 | 52A8.1_VK: [F10S] |
| 02 | 52A8.1_VK: [H44Y] |
| 03 | 52A8.1_VK: [H44F] |
| 04 | 52A8.1_VK: [G141Q] |
| 05 | 52A8.1_VH: [W57Y] |
| 06 | 52A8.1_VH: [R95S] |
| 07 | 52A8.1_VH: [W135Y] |
| | Antibody 54A1.1_N83D |
| 01 | 54A1.1_N83D_VK: [A5T] |
| 02 | 54A1.1_N83D_VK: [L46Q] |
| 03 | 54A1.1_N83D_VK: [G81S] |
| 04 | 54A1.1_N83D_VK: [F91L] |
| 05 | 54A1.1_N83D_VK: [I101F] |
| 06 | 54A1.1_N83D_VK: [I101V] |
| 07 | 54A1.1_N83D_VK: [P141G] |
| 08 | 54A1.1_N83D_VK: [P141Q] |
| 09 | 54A1.1_N83D_VH: [T48P] |
| 10 | 54A1.1_N83D_VH: [W57Y] |
| 11 | 54A1.1_N83D_VH: [W111Y] |
| | Antibody 56E7.3 |
| 01 | 56E7.3_VK: [N53K] |
| 02 | 56E7.3_VK: [F91L] |
| 03 | 56E7.3_VK: [I101F] |
| 04 | 56E7.3_VK: [P141Q] |
| 05 | 56E7.3_VK: [P141G] |
| 06 | 56E7.3_VK: [T144K] |
| 07 | 56E7.3_VK: [T144R] |
| 08 | 56E7.3_VH: [L31F] |
| 09 | 56E7.3_VH: [D65E] |
| 10 | 56E7.3_VH: [T84K] |
| 11 | 56E7.3_VH: [R95S] |
| | Antibody 58C2.1 |
| 01 | 58C2.1_VK: [D36E] |
| 02 | 58C2.1_VH: [R17G] |
| 03 | 58C2.1_VH: [D61E] |
| 04 | 58C2.1_VH: [D72E] |
| 05 | 58C2.1_VH: [N116Q] |
| | Antibody 60D7.1_N30T |
| 01 | 60D7.1_N30T_VK: [D33E] |
| 02 | 60D7.1_N30T_VK: [D36E] |
| 03 | 60D7.1_N30T_VH: [R17G] |
| 04 | 60D7.1_N30T_VH: [D61E] |
| 05 | 60D7.1_N30T_VH: [D72E] |
| 06 | 60D7.1_N30T_VH: [W115Y] |
| | Antibody 63A10.1_C58S |
| 01 | 63A10.1_C58S_VL: [H9L] |
| 02 | 63A10.1_C58S_VL: [H9P] |
| 03 | 63A10.1_C58S_VL: [T15L] |

TABLE 15-continued

| | | |
|---|---|---|
| 04 | 63A10.1_C58S_VL: | [T15P] |
| 05 | 63A10.1_C58S_VL: | [A16G] |
| 06 | 63A10.1_C58S_VL: | [M18T] |
| 07 | 63A10.1_C58S_VL: | [D51A] |
| 08 | 63A10.1_C58S_VL: | [D51S] |
| 09 | 63A10.1_C58S_VL: | [D51F] |
| 10 | 63A10.1_C58S_VL: | [D67E] |
| 11 | 63A10.1_C58S_VL: | [P83S] |
| 12 | 63A10.1_C58S_VL: | [E97Q] |
| 13 | 63A10.1_C58S_VL: | [D110E] |
| 14 | 63A10.1_C58S_VL: | [D136E] |
| 15 | 63A10.1_C58S_VH: | [D11G] |
| 16 | 63A10.1_C58S_VH: | [K14Q] |
| 17 | 63A10.1_C58S_VH: | [I29F] |
| 18 | 63A10.1_C58S_VH: | [G56S] |
| 19 | 63A10.1_C58S_VH: | [D64E] |
| 20 | 63A10.1_C58S_VH: | [G84D] |
| 21 | 63A10.1_C58S_VH: | [G84N] |
| 22 | 63A10.1_C58S_VH: | [T98A] |
| 23 | 63A10.1_C58S_VH: | [T107A] |
| 24 | 63A10.1_C58S_VH: | [T108R] |
| 25 | 63A10.1_C58S_VH: | [D109E] |
| 26 | 63A10.1_C58S_VL: | [W109Y] |
| Antibody 63A10.3_N20R_C42S | | |
| 01 | 63A10.3_N20R_C42S_VL: | [W109Y] |
| 02 | 63A10.3_N20R_C42S_VL: | [D67E] |
| 03 | 63A10.3_N20R_C42S_VL: | [D110E] |
| 04 | 63A10.3_N20R_C42S_VH: | [D11G] |
| 05 | 63A10.3_N20R_C42S_VH: | [K14Q] |
| 06 | 63A10.3_N20R_C42S_VH: | [I29F] |
| 07 | 63A10.3_N20R_C42S_VH: | [G56S] |
| 08 | 63A10.3_N20R_C42S_VH: | [D64E] |
| 09 | 63A10.3_N20R_C42S_VH: | [G84N] |
| 10 | 63A10.3_N20R_C42S_VH: | [T98A] |
| 11 | 63A10.3_N20R_C42S_VH: | [T107A] |
| 12 | 63A10.3_N20R_C42S_VH: | [T108R] |
| 13 | 63A10.3_N20R_C42S_VH: | [D109E] |
| 14 | 63A10.3_N20R_C42S_VL: | [W109Y] |
| Antibody 64B10.1 | | |
| 01 | 64B10.1_VL: | [G92A] |
| 02 | 64B10.1_VL: | [G99E] |
| 03 | 64B10.1_VL: | [D110E] |
| 04 | 64B10.1_VH: | [L5Q] |
| 05 | 64B10.1_VH: | [T144L] |
| 06 | 64B10.1_VH: | [T144M] |
| 07 | 64B10.1_VL: | [W109Y] |
| 08 | 64B10.1_VH: | [W113Y] |
| Antibody 66G2 | | |
| 01 | 66G2_VK: | [R54L] |
| 02 | 66G2_VK: | [K88E] |
| 03 | 66G2_VK: | [K88D] |
| 04 | 66G2_VK: | [N110Q] |
| 05 | 66G2_VH: | [R17G] |
| 06 | 66G2_VH: | [D61E] |
| 07 | 66G2_VH: | [D72E] |
| 08 | 66G2_VH: | [I78F] |
| 09 | 66G2_VH: | [T108K] |
| 10 | 66G2_VH: | [T108R] |
| Antibody 67F5 | | |
| 1. 01 | 67F5_VK: | [H57Y] |
| 2. 02 | 67F5_VK: | [Q97E] |
| 3. 03 | 67F5_VK: | [S98P] |
| 4. 04 | 67F5_VK: | [A99E] |
| 5. 05 | 67F5_VK: | [N105Y] |
| 6. 06 | 67F5_VH: | [K5Q] |
| 7. 07 | 67F5_VK: | [W135Y] |
| 8. 08 | 67F5_VK: | [W137Y] |
| Antibody 67C10 | | |
| 1. 01 | 67C10_VK: | [F2I] |
| 2. 02 | 67C10_VK: | [D36E] |
| 3. 03 | 67C10_VH: | [Q24K] |
| 4. 04 | 67C10_VH: | [D65E] |
| Antibody 68C8 | | |
| 1. 01 | 68C8_VL: | [G92A] |
| 2. 02 | 68C8_VL: | [G99E] |
| 3. 03 | 68C8_VL: | [D110E] |
| 4. 04 | 68C8_VH: | [D29G] |
| 5. 05 | 68C8_VH: | [H83D] |
| 6. 06 | 68C8_VH: | [G107A] |
| 7. 07 | 68C8_VH: | [T144L] |
| 8. 08 | 68C8_VH: | [T144M] |
| 9. 09 | 68C8_VL: | [W109Y] |
| 10. 10 | 68C8_VH: | [W113Y] |

TABLE 16

Exemplary Substitutions

>49C8.1 VK
(SEQ ID NO: 1912)
DIQMTQSPSSLSASVGDRVTFTCQASQDINIYLNWYQQKPGKAPKLLIYDVSNLETG
VPSRFSGSGSGTDFTFTISSLQPEDIA TYFCQQYDNLPFTFGPGTKVDLKR

>49C8.1 VH
(SEQ ID NO: 1913)
QVQLVQSGAEVKKPGASVKVSCKASGYTFTSYDIDWVRQATGQGLEWMGWMNPN
GGNTGYAQKFQGRVTMTRDTSINTA YMELSSLRSEDTAIYYCARGKEFSRAEFDYW
GQGTLVTVSS

>49H12 N83D VK
(SEQ ID NO: 1914)
DIQMTQSPSSLSASVGDRVTITCQASQDITKYLNWYQQKPGKAPKLLIYDTFILETGV
PSRFSGSGSGTDFTFTISSLQPEDIATYYCQQYDNLPLTFGQGTRLEIKR

>49H12 N83D VH
(SEQ ID NO: 1915)
QVQLVQSGAEVKKPGASVKVSCMASGYIFTSYDINWVRQATGQGPEWMGWMNPY
SGSTGYAQNFQGRVTMTRDTSINTAYMELSSLRSEDTAVYYCAKYNWNYGAFDFW
GQGTMVTVSS

>49G3.3 VK
(SEQ ID NO: 1916)
DIQMTQSPSSLSASIGDRVTITCQASQGISNYLNWYQQKPGKAPKLLIYDASNLETGV
PSRFSGSGSGTDFTFTISSLQPEDIATYYCHQYDDLPLTFGGGTKVEIRR

TABLE 16-continued

Exemplary Substitutions

>49G3.3 VH
(SEQ ID NO: 1917)
QVTLKESGPVLVKPTETLTLTCTVSGFSLSNPRMGVSWIRQPPGKALEWLTHIFSNDE
KSYSTSLKSRL TISKDTSKSQVVLSMTNMDPVDTATYYCVRVDTLNYHYYGMDVW
GQGTTVTVSS

>51A8.1 VL
(SEQ ID NO: 1918)
NFILTQPHSVSESPGKTVTISCTRSSGSIASDYVQWYQQRPGSSPTTVIYEDKERSSGV
PDRFSGSIDSSSNSASL TISGLKIEDEADYYCQSYDRNNHVVFGGGTKLTVLG

>51A8.1 VH
(SEQ ID NO: 1919)
QVQL VESGGGVVQPGRSLRLSCAASGFTFSSYGMHWVRQAPGKGLEWV A VISYDG
SNKYY ADSVKGRFTISRDNSKNTL YLQMNSLRAEDTA VYYCARADGDYPYYYYY
GMDVWGQGTTVTVSS

>51E5.1 VK
(SEQ ID NO: 1920)
DIQMTQSPSSLSASVGDRVTITCRASQDIRNDLGWYQQKPGKAPNRLIY AASSLQFG
VPSRFSGSGSGTEFTL TISSLQPEDFATYYCLQHSSYPLTFGGGTRVEIKR

>51E5.1 VH
(SEQ ID NO: 1921)
QVQLQQWGAGLLKPSETLSLTCA VYGGSFSGYYWSWIRQPPGKGLEWIGELDHSGSI
NYNPSLKSRVTISVDTSKNQFSLKLTSVTAADTA VYYCARVLGSTLDYWGQGTLVT
VSS

>52A8.1 VK
(SEQ ID NO: 1922)
DIQMTQSPSFLSASVGDRVTITCRASQTISSYLNWHQQKPGKAPKLLIY AASSLQSGV
PSRFSGSGSGTDFSL TISSLQPEDF ATYYCQQSYSTPLTFGGGTKVEIKR

>52A8.1 VH
(SEQ ID NO: 1923)
QVQLVQSGAEVKKPGASVKVSCKASGYTFTGYYLHWVRQAPGQGLEWMGWINPN
SAATNY APKFQGRVTVTRDTSISTA YMELSRLRSDDTA VYYCAREGGTYNWFDPWG
QGTLVTVSS

>54A1.1 N83D VK
(SEQ ID NO: 1924)
DIQMAQSPSSLSASVGDRVTITCQASQDISIYLNWYQLKPGKAPKLLIYDVSNLETGV
PSRFSGGGSGTDFTFTISSLQPEDIATYYCQQYDNLPLTFGPGTKVDIKR

>54A1.1 N83D VH
(SEQ ID NO: 1925)
QVQLVQSGAEVKKPGASVKVSCKASGYTFTSYDINWVRQATGQGLEWMGWMNPH
SGNTGYAQKFQGRVTMTRDTSINTAYMELSSLRSEDTAVYYCAKYNWNYGAFDFW
GQGTMVTVSS

>56E7.3 VK
(SEQ ID NO: 1926)
DLQMTQSPSSLSASVGDRVTITCQASQDIKKFLNWYQQKPGKAPNLLIYDASNLETG
VPSRFSGSGSGTDFTFTISSLQPEDIA TYYCQQY AILPFTFGPGTTVDIKR

>56E7.3 VH
(SEQ ID NO: 1927)
EVQLVQSGPEVKKPGESLKISCKGSGYSLTSYWIGWVRQMPGKGLEWMGIIYPGDS
DTRYSPSFQGQVTISADTSISTA YLQWSRLKASDTA VYYCARAQLGIFDYWGQGTLV
TVSS

>58C2.1 VK
(SEQ ID NO: 1928)
EIVMTQTPLSLPVTPGEPASISCRSSQSLFDNDDGDTYLDWYLQKPGQSPQLLIYTLSY
RASGVPDRFSGSGSGTDFTLKISRVEAEDVGVYYCMQRLEFPITFGQGTRLEIKR

>58C2.1 VH
(SEQ ID NO: 1929)
QVQL VESGGGVVQPGRSLRLSCAASGFTFSNYGMHWVRQAPGKGLEWV A VIWND
GNNKYY ADSVKGRFTISRDNSKNTL YLQMNSLRAEDTA VYYCARDQNYDFWNGYP
YYFYYGMDVWGQGTTVTVSS

>60D7.1 N30T VK
(SEQ ID NO: 1930)
DIVLTQTPLSLPVTPGEPASISCRSSQSLLDSDDGDTYLDWYLQKPGQSPQLLIYTLSY
RASGVPDRFSGSGSGTDFTLKISRVEAEDVGVYYCMQRIEFPLTFGGGTKVEIKR

TABLE 16-continued

Exemplary Substitutions

>60D7.1 N30T VH
(SEQ ID NO: 1931)
QVQLVESGGGVVQPGRSLRLSCAASGFTFSSYGMHWVRQAPGKGLEWVAVIWYDG
SNKYYADSVKGRFTISRDNSKNTLYLQMNSLRAEDTAVFYCARDQYFDFWSGYPFF
YYYGMDVWGQGTTVTVSS

>63A10.1 C58S VL
(SEQ ID NO: 1932)
SYELTQPHSVSVATAQMARITCGGNNIGSKAVHWYQQKPGQDPVLVIYSDSNRPSGI
PERFSGSNPGNTATLTISRIEAGDEADYYCQVWDSSSDGVFGGGTKLTVLG

>63A10.1 C58S VH
(SEQ ID NO: 1933)
EVQLVESGGDLVKPGGSLRLSCAVSGITFSNAWMSWVRQAPGKGLEWVGRIKSKTD
GGTTDYAAPVKGRFTVSRDGSKNTLYLQMNSLKTEDTAVYYCTTDSSGSYYVEDYF
DYWGQGTLVTVSS

>63A10.3 N20R C42S VL
(SEQ ID NO: 1934)
SYELTQPPSVSVSPGQTARITCSGDKLGNRYTSWYQQKSGQSPVLVIYQDSERPSGIP
ERFSGSNSGNTATL TISGTQAMDEADYYCQAWDSTTVVFGGGTKLTVLG

>63A10.3 N20R C42S VH
(SEQ ID NO: 1935)
EVQLVESGGDLVKPGGSLRLSCAVSGITFSNAWMSWVRQAPGKGLEWVGRIKSKTD
GGTTDYAAPVKGRFTVSRDGSKNTLYLQMNSLKTEDTAVYYCTTDSSGSYYVEDYF
DYWGQGTLVTVSS

>64B10.1 VL
(SEQ ID NO: 1936)
QSVLTQPPSVSAAPGQKVTISCSGSSSNIGNNYVAWYQQLPGTAPKLLIYDNDKRPSG
IPDRFSGSKSGTSATLGITGLQTGDEADYYCGTWDSSLSAVVFGGGTKLTVLG

>64B10.1 VH
(SEQ ID NO: 1937)
QIQLLESGPGLVKPSETLSLTCTVSGGSVSSGDYYWSWIRQPPGKGLEWIGFIYYSGG
TNYNPSLKSRVTISIDTSKNQFSLKLNSVTAADTAVYYCARYSSTWDYYYGVDVWG
QGTTVTVSS

>66G2 VK
(SEQ ID NO: 1938)
DIQMTQSPSSLSASVGDRVTITCRASQGIRNDLGWYQQKPGKAPKRLIYAASNLQSG
VPSRFSGSGSGTKFTLTINSLQPEDFATYYCLQLNGYPLTFGGGTKVEIKR

>66G2 VH
(SEQ ID NO: 1939)
QVQLVESGGGVVQPGRSLRLSCAASGFTFSSYGMHWVRQAPGKGLEWV AGISYDG
SNKNY ADSVKGRITISRDNPKNTLYLQMNSLRAEDTAVYYCATTVTKEDYYYGM
DVWGQGTTVTVSS

>67F5 VK
(SEQ ID NO: 1940)
ENMTQSPATLSVSPGERVTLSCRASQSVSSNLA WYQQKPGQAPRLLIHGSSNRAIGIP
ARFSGSGSGTEFTLTISSLQSADFAVYNCQQYEIWPWTFGQGTKVEIKR

>67F5 VH
(SEQ ID NO: 1941)
QVQLKESGPGLVKPSETLSLTCTVSGGSISSYYWSWIRQPPGKGLEWIGYIYYSGNTN
YNPSLKSRVTISVDTSKNQFSLKLSSVTAADTAVYYCAREYYYGSGSYYPWGQGTL
VTVSS

>67C10 VK
(SEQ ID NO: 1942)
DFVMTQTPLSLPVTPGEPASISCRSSQSLLNSDDGNTYLDWYLQKPGQSPQLLIYTLS
YRASGVPDRFSGSGSGTDFTLKISRVEAEDVGVYYCMQRIEFPITFGQGTRLEIKR

>67C10 VH
(SEQ ID NO: 1943)
EVQLVQSGAEVKKPGESLKISCQGSGYSFSSYWIGWVRQMPGKGLEWMGIIYPGDS
DTRYSPSFQGQVTISADKSINTA YLQWSSLKASDTAIYYCARRASRGYRYGLAFAIW
GQGTMVTVSS

>68C8 VL
(SEQ ID NO: 1944)
QSVLTQPPSVSAAPGQKVTISCSGSSSNIGNNYVSWYQQLPGTAPKLLIYDNNKRPSG
IPDRFSGSKSGTSATLGITGLQTGDEADYYCGTWDSSLSAVVFGGGTKLTVLG

TABLE 16-continued

Exemplary Substitutions

>68C8 VH
(SEQ ID NO: 1945)
QVQLQESGPGLVKPSETLSLTCTVSGDSVSSGDNYWSWIRQPPGKGLEWIGFMFYSG
STNYNPSLKSRVTISLHTSKNQFSLRLSSVTAADTAVYYCGRYRSDWDYYYGMDVW
GQGTTVTVSS

>49C8.1 VK.02
(SEQ ID NO: 1946)
DIQMTQSPSSLSASVGDRVTITCQASQDINIYLNWYQQKPGKAPKLLIYDVSNLETGV
PSRFSGSGSGTDFTLTISSLQPEDIATYFCQQYDNLPFTFGPGTKVDLKR

>49C8.1 VH
(SEQ ID NO: 1913)
QVQLVQSGAEVKKPGASVKVSCKASGYTFTSYDIDWVRQATGQGLEWMGWMNPN
GGNTGY AQKFQGRVTMTRDTSINTA YMELSSLRSEDTAIYYCARGKEFSRAEFDYW
GQGTLVTVSS

>49C8.1 VK.03
(SEQ ID NO: 1947)
DIQMTQSPSSLSASVGDRVTFTCQASQDINIYLNWYQQKPGKAPKLLIYDVSNLETG
VPSRFSGSGSGTDFTLTISSLQPEDIATYFCQQYDNLPFTFGPGTKVDLKR

>49C8.1 VH
(SEQ ID NO: 1913)
QVQLVQSGAEVKKPGASVKVSCKASGYTFTSYDIDWVRQATGQGLEWMGWMNPN
GGNTGYAQKFQGRVTMTRDTSINTAYMELSSLRSEDTAIYYCARGKEFSRAEFDYWGQ
GTLVTVSS

>49C8.1 VK.04
(SEQ ID NO: 1948)
DIQMTQSPSSLSASVGDRVTFTCQASQDINIYLNWYQQKPGKAPKLLIYDVSNLETG
VPSRFSGSGSGTDFTFTISSLQPEDF ATYFCQQYDNLPFTFGPGTKVDLKR

>49C8.1 VH
(SEQ ID NO: 1913)
QVQLVQSGAEVKKPGASVKVSCKASGYTFTSYDIDWVRQATGQGLEWMGWMNPN
GGNTGY AQKFQGRVTMTRDTSINTAYMELSSLRSEDTAIYYCARGKEFSRAEFDYW
GQGTLVTVSS

>49C8.1 VK.05
(SEQ ID NO: 1949)
DIQMTQSPSSLSASVGDRVTFTCQASQDINIYLNWYQQKPGKAPKLLIYDVSNLETG
VPSRFSGSGSGTDFTFTISSLQPEDV ATYFCQQYDNLPFTFGPGTKVDLKR

>49C8.1 VH
(SEQ ID NO: 1913)
QVQLVQSGAEVKKPGASVKVSCKASGYTFTSYDIDWVRQATGQGLEWMGWMNPN
GGNTGY AQKFQGRVTMTRDTSINTAYMELSSLRSEDTAIYYCARGKEFSRAEFDYW
GQGTLVTVSS

>49C8.1 VK.06
(SEQ ID NO: 1950)
DIQMTQSPSSLSASVGDRVTFTCQASQDINIYLNWYQQKPGKAPKLLIYDVSNLETG
VPSRFSGSGSGTDFTFTISSLQPEDIATYFCQQYDNLPFTFGQGTKVDLKR

>49C8.1 VH
(SEQ ID NO: 1913)
QVQLVQSGAEVKKPGASVKVSCKASGYTFTSYDIDWVRQATGQGLEWMGWMNPN
GGNTGY AQKFQGRVTMTRDTSINTAYMELSSLRSEDTAIYYCARGKEFSRAEFDYW
GQGTLVTVSS

>49C8.1 VK.07
(SEQ ID NO: 1951)
DIQMTQSPSSLSASVGDRVTFTCQASQDINIYLNWYQQKPGKAPKLLIYDVSNLETG
VPSRFSGSGSGTDFTFTISSLQPEDIATYFCQQYDNLPFTFGGGTKVDLKR

>49C8.1 VH
(SEQ ID NO: 1913)
QVQLVQSGAEVKKPGASVKVSCKASGYTFTSYDIDWVRQATGQGLEWMGWMNPN
GGNTGYAQKFQGRVTMTRDTSINTAYMELSSLRSEDTAIYYCARGKEFSRAEFDYW
GQGTLVTVSS

>49C8.1 VK
(SEQ ID NO: 1912)
DIQMTQSPSSLSASVGDRVTFTCQASQDINIYLNWYQQKPGKAPKLLIYDVSNLETG
VPSRFSGSGSGTDFTFTISSLQPEDIATYFCQQYDNLPFTFGPGTKVDLKR

TABLE 16-continued

Exemplary Substitutions

>49C8.1 VH.08
(SEQ ID NO: 1952)
QVQLVQSGAEVKKPGASVKVSCKASGYTFTSYDIDWVRQAPGQGLEWMGWMNPN
GGNTGYAQKFQGRVTMTRDTSINTAYMELSSLRSEDTAIYYCARGKEFSRAEFDYW
GQGTLVTVSS

>49C8.1 VK
(SEQ ID NO: 1912)
DIQMTQSPSSLSASVGDRVTFTCQASQDINIYLNWYQQKPGKAPKLLIYDVSNLETG
VPSRFSGSGSGTDFTFTISSLQPEDIA TYFCQQYDNLPFTFGPGTKVDLKR

>49C8.1 VH.09
(SEQ ID NO: 1953)
QVQLVQSGAEVKKPGASVKVSCKASGYTFTSYDIDWVRQATGQGLEWMGWMNPQ
GGNTGY AQKFQGRVTMTRDTSINTA YMELSSLRSEDTAIYYCARGKEFSRAEFDYW
GQGTLVTVSS

>49C8.1 VK
(SEQ ID NO: 1912)
DIQMTQSPSSLSASVGDRVTFTCQASQDINIYLNWYQQKPGKAPKLLIYDVSNLETG
VPSRFSGSGSGTDFTFTISSLQPEDIATYFCQQYDNLPFTFGPGTKVDLKR

>49C8.1 VH.10
(SEQ ID NO: 1954)
QVQLVQSGAEVKKPGASVKVSCKASGYTFTSYDIDWVRQATGQGLEWMGWMNPN
TGNTGYAQKFQGRVTMTRDTSINTAYMELSSLRSEDTAIYYCARGKEFSRAEFDYW
GQGTLVTVSS

>49H12 N83D VK.01
(SEQ ID NO: 1955)
DIQMTQSPSSLSASVGDRVTITCQASQDITKYLNWYQQKPGKAPKLLIYDTFILETGV
PSRFSGSGSGTDFTL TISSLQPEDIATYYCQQYDNLPLTFGQGTRLEIKR

>49H12 N83D VH
(SEQ ID NO: 1915)
QVQLVQSGAEVKKPGASVKVSCMASGYIFTSYDINWVRQATGQGPEWMGWMNPY
SGSTGYAQNFQGRVTMTRDTSINTAYMELSSLRSEDTAVYYCAKYNWNYGAFDFW
GQGTMVTVSS

>49H12 N83D VK.02
(SEQ ID NO: 1956)
DIQMTQSPSSLSASVGDRVTITCQASQDITKYLNWYQQKPGKAPKLLIYDTFILETGV
PSRFSGSGSGTDFTFTISSLQPEDFATYYCQQYDNLPLTFGQGTRLEIKR

>49H12 N83D VH
(SEQ ID NO: 1915)
QVQLVQSGAEVKKPGASVKVSCMASGYIFTSYDINWVRQATGQGPEWMGWMNPY
SGSTGYAQNFQGRVTMTRDTSINTAYMELSSLRSEDTA VYYCAKYNWNYGAFDFW
GQGTMVTVSS

>49H12 N83D VK.03
(SEQ ID NO: 1957)
DIQMTQSPSSLSASVGDRVTITCQASQDITKYLNWYQQKPGKAPKLLIYDTFILETGV
PSRFSGSGSGTDFTFTISSLQPEDVATYYCQQYDNLPLTFGQGTRLEIKR

>49H12 N83D VH
(SEQ ID NO: 1915)
QVQLVQSGAEVKKPGASVKVSCMASGYIFTSYDINWVRQATGQGPEWMGWMNPY
SGSTGYAQNFQGRVTMTRDTSINTAYMELSSLRSEDTAVYYCAKYNWNYGAFDFW
GQGTMVTVSS

>49H12 N83D VK
(SEQ ID NO: 1914)
DIQMTQSPSSLSASVGDRVTITCQASQDITKYLNWYQQKPGKAPKLLIYDTFILETGV
PSRFSGSGSGTDFTFTISSLQPEDIATYYCQQYDNLPLTFGQGTRLEIKR

>49H12 N83D VH.04
(SEQ ID NO: 1958)
QVQLVQSGAEVKKPGASVKVSCKASGYIFTSYDINWVRQATGQGPEWMGWMNPYS
GSTGYAQNFQGRVTMTRDTSINTAYMELSSLRSEDTAVYYCAKYNWNYGAFDFWG
QGTMVTVSS

>49H12 N83D VK
(SEQ ID NO: 1914)
DIQMTQSPSSLSASVGDRVTITCQASQDITKYLNWYQQKPGKAPKLLIYDTFILETGV
PSRFSGSGSGTDFTFTISSLQPEDIATYYCQQYDNLPLTFGQGTRLEIKR

TABLE 16-continued

Exemplary Substitutions

>49H12 N83D VH.05
(SEQ ID NO: 1959)
QVQLVQSGAEVKKPGASVKVSCMASGYTFTSYDINWVRQATGQGPEWMGWMNPY
SGSTGYAQNFQGRVTMTRDTSINTAYMELSSLRSEDTAVYYCAKYNWNYGAFDFW
GQGTMVTVSS

>49H12 N83D VK
(SEQ ID NO: 1914)
DIQMTQSPSSLSASVGDRVTITCQASQDITKYLNWYQQKPGKAPKLLIYDTFILETGV
PSRFSGSGSGTDFTFTISSLQPEDIATYYCQQYDNLPLTFGQGTRLEIKR

>49H12 N83D VH.06
(SEQ ID NO: 1960)
QVQLVQSGAEVKKPGASVKVSCMASGYIFTSYDINWVRQAPGQGPEWMGWMNPY
SGSTGYAQNFQGRVTMTRDTSINTAYMELSSLRSEDTAVYYCAKYNWNYGAFDFW
GQGTMVTVSS

>49H12 N83D VK
(SEQ ID NO: 1914)
DIQMTQSPSSLSASVGDRVTITCQASQDITKYLNWYQQKPGKAPKLLIYDTFILETGV
PSRFSGSGSGTDFTFTISSLQPEDIATYYCQQYDNLPLTFGQGTRLEIKR

>49H12 N83D VH.07
(SEQ ID NO: 1961)
QVQLVQSGAEVKKPGASVKVSCMASGYIFTSYDINWVRQATGQGPEWMGYMNPYS
GSTGYAQNFQGRVTMTRDTSINTAYMELSSLRSEDTAVYYCAKYNWNYGAFDFWG
QGTMVTVSS

>49H12 N83D VK
(SEQ ID NO: 1914)
DIQMTQSPSSLSASVGDRVTITCQASQDITKYLNWYQQKPGKAPKLLIYDTFILETGV
PSRFSGSGSGTDFTFTISSLQPEDIATYYCQQYDNLPLTFGQGTRLEIKR

>49H12 N83D VH.08
(SEQ ID NO: 1962)
QVQLVQSGAEVKKPGASVKVSCMASGYIFTSYDINWVRQATGQGPEWMGWMNPY
SGSTGYAQNFQGRVTMTRDTSINTA YMELSSLRSEDTAVYYCAKYNYNYGAFDFW
GQGTMVTVSS

>49G3.3 VK.01
(SEQ ID NO: 1963)
DIQMTQSPSSLSASIGDRVTITCQASQGISNYLNWYQQKPGKAPKLLIYDASNLETGV
PSRFSGSGSGTDFTLTISSLQPEDIATYYCHQYDDLPLTFGGGTKVEIRR

>49G3.3 VH
(SEQ ID NO: 1917)
QVTLKESGPVLVKPTETLTLTCTVSGFSLSNPRMGVSWIRQPPGKALEWLTHIFSNDE
KSYSTSLKSRLTISKDTSKSQVVLSMTNMDPVDTATYYCVRVDTLNYHYYGMDVW
GQGTTVTVSS

>49G3.3 VK.02
(SEQ ID NO: 1964)
DIQMTQSPSSLSASIGDRVTITCQASQGISNYLNWYQQKPGKAPKLLIYDASNLETGV
PSRFSGSGSGTDFTFTISSLQPEDF ATYYCHQYDDLPLTFGGGTKVEIRR

>49G3.3 VH
(SEQ ID NO: 1917)
QVTLKESGPVLVKPTETLTLTCTVSGFSLSNPRMGVSWIRQPPGKALEWLTHIFSNDE
KSYSTSLKSRLTISKDTSKSQVVLSMTNMDPVDTATYYCVRVDTLNYHYYGMDVW
GQGTTVTVSS

>49G3.3 VK.03
(SEQ ID NO: 1965)
DIQMTQSPSSLSASIGDRVTITCQASQGISNYLNWYQQKPGKAPKLLIYDASNLETGV
PSRFSGSGSGTDFTFTISSLQPEDVA TYYCHQYDDLPLTFGGGTKVEIRR

>49G3.3 VH
(SEQ ID NO: 1917)
QVTLKESGPVLVKPTETLTLTCTVSGFSLSNPRMGVSWIRQPPGKALEWLTHIFSNDE
KSYSTSLKSRL TISKDTSKSQVVLSMTNMDPVDTATYYCVRVDTLNYHYYGMDVW
GQGTTVTVSS

>49G3.3 VK.04
(SEQ ID NO: 1966)
DIQMTQSPSSLSASIGDRVTITCQASQGISNYLNWYQQKPGKAPKLLIYDASNLETGV
PSRFSGSGSGTDFTFTISSLQPEDIATYYCHQYDDLPLTFGQGTKVEIRR

TABLE 16-continued

Exemplary Substitutions

>49G3.3 VH
(SEQ ID NO: 1917)
QVTLKESGPVLVKPTETLTLTCTVSGFSLSNPRMGVSWIRQPPGKALEWLTHIFSNDE
KSYSTSLKSRLTISKDTSKSQVVLSMTNMDPVDTATYYCVRVDTLNYHYYGMDVW
GQGTTVTVSS

>49G3.3 VK
(SEQ ID NO: 1916)
DIQMTQSPSSLSASIGDRVTITCQASQGISNYLNWYQQKPGKAPKLLIYDASNLETGV
PSRFSGSGSGTDFTFTISSLQPEDIATYYCHQYDDLPLTFGGGTKVEIRR

>49G3.3 VH.05
(SEQ ID NO: 1967)
QVTLKESGPVLVKPTQTLTLTCTVSGFSLSNPRMGVSWIRQPPGKALEWLTHIFSNDE
KSYSTSLKSRLTISKDTSKSQVVLSMTNMDPVDTATYYCVRVDTLNYHYYGMDVW
GQGTTVTVSS

>49G3.3 VK
(SEQ ID NO: 1916)
DIQMTQSPSSLSASIGDRVTITCQASQGISNYLNWYQQKPGKAPKLLIYDASNLETGV
PSRFSGSGSGTDFTFTISSLQPEDIATYYCHQYDDLPLTFGGGTKVEIRR

>49G3.3 VH.06
(SEQ ID NO: 1968)
QVTLKESGPVLVKPTETLTLTCTFSGFSLSNPRMGVSWIRQPPGKALEWLTHIFSNDE
KSYSTSLKSRLTISKDTSKSQVVLSMTNMDPVDTATYYCVRVDTLNYHYYGMDVW
GQGTTVTVSS

>49G3.3 VK
(SEQ ID NO: 1916)
DIQMTQSPSSLSASIGDRVTITCQASQGISNYLNWYQQKPGKAPKLLIYDASNLETGV
PSRFSGSGSGTDFTFTISSLQPEDIATYYCHQYDDLPLTFGGGTKVEIRR

>49G3.3 VH.07
(SEQ ID NO: 1969)
QVTLKESGPVLVKPTETLTLTCTVSGFSLSNPRMGVSWIRQPPGKALEWLAHIFSNDE
KSYSTSLKSRL TISKDTSKSQVVLSMTNMDPVDTATYYCVRVDTLNYHYYGMDVW
GQGTTVTVSS

>49G3.3_VK
(SEQ ID NO: 1916)
DIQMTQSPSSLSASIGDRVTITCQASQGISNYLNWYQQKPGKAPKLLIYDASNLETGV
PSRFSGSGSGTDFTFTISSLQPEDIATYYCHQYDDLPLTFGGGTKVEIRR

>49G3.3_VH.08
(SEQ ID NO: 1970)
QVTLKESGPVLVKPTETLTLTCTVSGFSLSNPRMGVSWIRQPPGKALEWLGHIFSNDE
KSYSTSLKSRL TISKDTSKSQVVLSMTNMDPVDTATYYCVRVDTLNYHYYGMDVW
GQGTTVTVSS

>49G3.3_VK
(SEQ ID NO: 1916)
DIQMTQSPSSLSASIGDRVTITCQASQGISNYLNWYQQKPGKAPKLLIYDASNLETGV
PSRFSGSGSGTDFTFTISSLQPEDIATYYCHQYDDLPLTFGGGTKVEIRR

>49G3.3_VH.09
(SEQ ID NO: 1971)
QVTLKESGPVLVKPTETLTLTCTVSGFSLSNPRMGVSWIRQPPGKALEWLTHIFSNDE
KSYSTSLKSRL TISKDTSKSQVVLSMTNMDPVDTATYYCVRVDTLNYHYYGMDVW
GQGTLVTVSS

>49G3.3_VK
(SEQ ID NO: 1916)
DIQMTQSPSSLSASIGDRVTITCQASQGISNYLNWYQQKPGKAPKLLIYDASNLETGV
PSRFSGSGSGTDFTFTISSLQPEDIATYYCHQYDDLPLTFGGGTKVEIRR

>49G3.3_VH.10
(SEQ ID NO: 1972)
QVTLKESGPVLVKPTETLTLTCTVSGFSLSNPRMGVSWIRQPPGKALEWLTHIFSNDE
KSYSTSLKSRLTISKDTSKSQVVLSMTNMDPVDTATYYCVRVDTLNYHYYGMDVW
GQGTMVTVSS

>51A8.1_VL.01
(SEQ ID NO: 1973)
NFILTQPHSVSESPGKTVTISCTRSSGSIASDYVQWYQQRPGSSPTTVIYEDKERSSGV
PDRFSGSIDSSSNSASLTISGLKTEDEADYYCQSYDRNNHVVFGGGTKLTVLG

TABLE 16-continued

Exemplary Substitutions

>51A8.1_VH
(SEQ ID NO: 1919)
QVQLVESGGGVVQPGRSLRLSCAASGFTFSSYGMHWVRQAPGKGLEWV A VISYDG
SNKYY ADSVKGRFTISRDNSKNTLYLQMNSLRAEDTAVYYCARADGDYPYYYYYY
GMDVWGQGTTVTVSS

>51A8.1_VL.02
(SEQ ID NO: 1974)
NFILTQPHSVSESPGKTVTISCTRSSGSIASDYVQWYQQRPGSSPTTVIYEDKERSSGV
PDRFSGSIDSSSNSASLTISGLKAEDEADYYCQSYDRNNHVVFGGGTKLTVLG

>51A8.1_VH
(SEQ ID NO: 1919)
QVQLVESGGGVVQPGRSLRLSCAASGFTFSSYGMHWVRQAPGKGLEWVAVISYDG
SNKYYADSVKGRFTISRDNSKNTLYLQMNSLRAEDTAVYYCARADGDYPYYYYYY
GMDVWGQGTTVTVSS

>51A8.1_VL
(SEQ ID NO: 1918)
NFILTQPHSVSESPGKTVTISCTRSSGSIASDYVQWYQQRPGSSPTTVIYEDKERSSGV
PDRFSGSIDSSSNSASLTISGLKIEDEADYYCQSYDRNNHVVFGGGTKLTVLG

>51A8.1_VH.03
(SEQ ID NO: 1975)
QVQLVESGGGVVQPGGSLRLSCAASGFTFSSYGMHWVRQAPGKGLEWVAVISYDG
SNKYYADSVKGRFTISRDNSKNTLYLQMNSLRAEDTAVYYCARADGDYPYYYYYY
GMDVWGQGTTVTVSS

>51A8.1_VL
(SEQ ID NO: 1918)
NFILTQPHSVSESPGKTVTISCTRSSGSIASDYVQWYQQRPGSSPTTVIYEDKERSSGV
PDRFSGSIDSSSNSASLTISGLKIEDEADYYCQSYDRNNHVVFGGGTKLTVLG

>51A8.1_VH.04
(SEQ ID NO: 1976)
QVQLVESGGGVVQPGRSLRLSCAASGFTFSSYGMHWVRQAPGKGLEWVAVISYEGS
NKYYADSVKGRFTISRDNSKNTLYLQMNSLRAEDTAVYYCARADGDYPYYYYYG
MDVWGQGTTVTVSS

>51A8.1_VL
(SEQ ID NO: 1918)
NFILTQPHSVSESPGKTVTISCTRSSGSIASDYVQWYQQRPGSSPTTVIYEDKERSSGV
PDRFSGSIDSSSNSASLTISGLKIEDEADYYCQSYDRNNHVVFGGGTKLTVLG

>51A8.1_VH.05
(SEQ ID NO: 1977)
QVQLVESGGGVVQPGRSLRLSCAASGFTFSSYGMHWVRQAPGKGLEWV A VISYDG
SNKYY AESVKGRFTISRDNSKNTL YLQMNSLRAEDTA VYYCARADGDYPYYYYYY
GMDVWGQGTTVTVSS

>51A8.1_VL
(SEQ ID NO: 1918)
NFILTQPHSVSESPGKTVTISCTRSSGSIASDYVQWYQQRPGSSPTTVIYEDKERSSGV
PDRFSGSIDSSSNSASL TISGLKIEDEADYYCQSYDRNNHVVFGGGTKLTVLG

>51A8.1_VH.06
(SEQ ID NO: 1978)
QVQLVESGGGVVQPGRSLRLSCAASGFTFSSYGMHWVRQAPGKGLEWVAVISYDG
SNKYYADSVKGRFTISRDNSKNTLYLQMNSLRAEDTAVYYCARAEGDYPYYYYYY
GMDVWGQGTTVTVSS

>51E5.1_VK.01
(SEQ ID NO: 1979)
DIQMTQSPSSLSASVGDRVTITCRASQDIRNDLGWYQQKPGKAPKRLIYAASSLQFG
VPSRFSGSGSGTEFTLTISSLQPEDFATYYCLQHSSYPLTFGGGTRVEIKR

>51E5.1_VH
(SEQ ID NO: 1921)
QVQLQQWGAGLLKPSETLSLTCA VYGGSFSGYYWSWIRQPPGKGLEWIGELDHSGSI
NYNPSLKSRVTISVDTSKNQFSLKLTSVTAADTA VYYCARVLGSTLDYWGQGTLVT
VSS

>51E5.1_VK.02
(SEQ ID NO: 1980)
DIQMTQSPSSLSASVGDRVTITCRASQDIRNDLGWYQQKPGKAPNLLIYAASSLQFGV
PSRFSGSGSGTEFTL TISSLQPEDFATYYCLQHSSYPLTFGGGTRVEIKR

TABLE 16-continued

Exemplary Substitutions

>51E5.1_VH
(SEQ ID NO: 1921)
QVQLQQWGAGLLKPSETLSLTCAVYGGSFSGYYWSWIRQPPGKGLEWIGELDHSGSI
NYNPSLKSRVTISVDTSKNQFSLKLTSVTAADTA VYYCARVLGSTLDYWGQGTLVT
VSS

>51E5.1_VK.03
(SEQ ID NO: 1981)
DIQMTQSPSSLSASVGDRVTITCRASQDIRNDLGWYQQKPGKAPNSLIYAASSLQFGV
PSRFSGSGSGTEFTLTISSLQPEDFATYYCLQHSSYPLTFGGGTRVEIKR

>51E5.1_VH
(SEQ ID NO: 1921)
QVQLQQWGAGLLKPSETLSLTCAVYGGSFSGYYWSWIRQPPGKGLEWIGELDHSGSI
NYNPSLKSRVTISVDTSKNQFSLKLTSVTAADTAVYYCARVLGSTLDYWGQGTLVT
VSS

>51E5.1_VK.04
(SEQ ID NO: 1982)
DIQMTQSPSSLSASVGDRVTITCRASQDIRNDLGWYQQKPGKAPNRLIYAASSLQFG
VPSRFSGSGSGTEFTLTISSLQPEDFATYYCLQHSSYPLTFGQGTRVEIKR

>51E5.1_VH
(SEQ ID NO: 1921)
QVQLQQWGAGLLKPSETLSLTCA VYGGSFSGYYWSWIRQPPGKGLEWIGELDHSGSI
NYNPSLKSRVTISVDTSKNQFSLKLTSVTAADTA VYYCARVLGSTLDYWGQGTLVT
VSS

>51E5.1_VK
(SEQ ID NO: 1920)
DIQMTQSPSSLSASVGDRVTITCRASQDIRNDLGWYQQKPGKAPNRLIYAASSLQFG
VPSRFSGSGSGTEFTL TISSLQPEDF ATYYCLQHSSYPLTFGGGTRVEIKR

>51E5.1_VH.05
(SEQ ID NO: 1983)
QVQLQQWGAGLLKPSETLSLTCAVYGGSFSGYYWSWIRQPPGKGLEWIGELEHSGSI
NYNPSLKSRVTISVDTSKNQFSLKLTSVTAADTAVYYCARVLGSTLDYWGQGTLVT
VSS

>51E5.1_VK
(SEQ ID NO: 1920)
DIQMTQSPSSLSASVGDRVTITCRASQDIRNDLGWYQQKPGKAPNRLIY AASSLQFG
VPSRFSGSGSGTEFTL TISSLQPEDF ATYYCLQHSSYPLTFGGGTRVEIKR

>51E5.1_VH.06
(SEQ ID NO: 1984)
QVQLQQWGAGLLKPSETLSLTCAVYGGSFSGYYWSWIRQPPGKGLEWIGELDTSGSI
NYNPSLKSRVTISVDTSKNQFSLKLTSVTAADTA VYYCARVLGSTLDYWGQGTLVT
VSS

>52A8.1_VK.01
(SEQ ID NO: 1985)
DIQMTQSPSSLSASVGDRVTITCRASQTISSYLNWHQQKPGKAPKLLIYAASSLQSGV
PSRFSGSGSGTDFSL TISSLQPEDF ATYYCQQSYSTPLTFGGGTKVEIKR

>52A8.1_VH
(SEQ ID NO: 1923)
QVQLVQSGAEVKKPGASVKVSCKASGYTFTGYYLHWVRQAPGQGLEWMGWINPN
SAATNY APKFQGRVTVTRDTSISTAYMELSRLRSDDTAVYYCAREGGTYNWFDPWG
QGTLVTVSS

>52A8.1_VK.02
(SEQ ID NO: 1986)
DIQMTQSPSFLSASVGDRVTITCRASQTISSYLNWYQQKPGKAPKLLIY AASSLQSGV
PSRFSGSGSGTDFSL TISSLQPEDF ATYYCQQSYSTPLTFGGGTKVEIKR

>52A8.1_VH
(SEQ ID NO: 1923)
QVQLVQSGAEVKKPGASVKVSCKASGYTFTGYYLHWVRQAPGQGLEWMGWINPN
SAATNY APKFQGRVTVTRDTSISTA YMELSRLRSDDTAVYYCAREGGTYNWFDPWG
QGTLVTVSS

>52A8.1_VK.03
(SEQ ID NO: 1987)
DIQMTQSPSFLSASVGDRVTITCRASQTISSYLNWFQQKPGKAPKLLIYAASSLQSGVP
SRFSGSGSGTDFSLTISSLQPEDFATYYCQQSYSTPLTFGGGTKVEIKR

TABLE 16-continued

Exemplary Substitutions

>52A8.1_VH
(SEQ ID NO: 1923)
QVQLVQSGAEVKKPGASVKVSCKASGYTFTGYYLHWVRQAPGQGLEWMGWINPN
SAATNYAPKFQGRVTVTRDTSISTAYMELSRLRSDDTAVYYCAREGGTYNWFDPWG
QGTLVTVSS

>52A8.1_VK.04
(SEQ ID NO: 1988)
DIQMTQSPSFLSASVGDRVTITCRASQTISSYLNWHQQKPGKAPKLLIYAASSLQSGV
PSRFSGSGSGTDFSL TISSLQPEDF ATYYCQQSYSTPLTFGQGTKVEIKR

>52A8.1_VH
(SEQ ID NO: 1923)
QVQLVQSGAEVKKPGASVKVSCKASGYTFTGYYLHWVRQAPGQGLEWMGWINPN
SAATNYAPKFQGRVTVTRDTSISTAYMELSRLRSDDTAVYYCAREGGTYNWFDPWG
QGTLVTVSS

>52A8.1_VK
(SEQ ID NO: 1922)
DIQMTQSPSFLSASVGDRVTITCRASQTISSYLNWHQQKPGKAPKLLIY AASSLQSGV
PSRFSGSGSGTDFSL TISSLQPEDF ATYYCQQSYSTPLTFGGGTKVEIKR

>52A8.1_VH.05
(SEQ ID NO: 1989)
QVQLVQSGAEVKKPGASVKVSCKASGYTFTGYYLHWVRQAPGQGLEWMGYINPNS
AATNYAPKFQGRVTVTRDTSISTAYMELSRLRSDDTAVYYCAREGGTYNWFDPWG
QGTLVTVSS

>52A8.1_VK
(SEQ ID NO: 1922)
DIQMTQSPSFLSASVGDRVTITCRASQTISSYLNWHQQKPGKAPKLLIYAASSLQSGV
PSRFSGSGSGTDFSLTISSLQPEDFATYYCQQSYSTPLTFGGGTKVEIKR

>52A8.1_VH.06
(SEQ ID NO: 1990)
QVQLVQSGAEVKKPGASVKVSCKASGYTFTGYYLHWVRQAPGQGLEWMGWINPN
SAATNYAPKFQGRVTVTRDTSISTA YMELSSLRSDDTAVYYCAREGGTYNWFDPWG
QGTLVTVSS

>52A8.1_VK
(SEQ ID NO: 1922)
DIQMTQSPSFLSASVGDRVTITCRASQTISSYLNWHQQKPGKAPKLLIYAASSLQSGV
PSRFSGSGSGTDFSLTISSLQPEDFATYYCQQSYSTPLTFGGGTKVEIKR

>52A8.1_VH.07
(SEQ ID NO: 1991)
QVQLVQSGAEVKKPGASVKVSCKASGYTFTGYYLHWVRQAPGQGLEWMGWINPN
SAATNY APKFQGRVTVTRDTSISTA YMELSRLRSDDTA VYYCAREGGTYNYFDPWG
QGTLVTVSS

>54A1.1_N83D_VK.01
(SEQ ID NO: 1992)
DIQMTQSPSSLSASVGDRVTITCQASQDISIYLNWYQLKPGKAPKLLIYDVSNLETGV
PSRFSGGGSGTDFTFTISSLQPEDIATYYCQQYDNLPLTFGPGTKVDIKR

>54A1.1_N83D_VH
(SEQ ID NO: 1925)
QVQLVQSGAEVKKPGASVKVSCKASGYTFTSYDINWVRQATGQGLEWMGWMNPH
SGNTGYAQKFQGRVTMTRDTSINTAYMELSSLRSEDTAVYYCAKYNWNYGAFDFW
GQGTMVTVSS

>54A1.1_N83D_VK.02
(SEQ ID NO: 1993)
DIQMAQSPSSLSASVGDRVTITCQASQDISIYLNWYQQKPGKAPKLLIYDVSNLETGV
PSRFSGGGSGTDFTFTISSLQPEDIATYYCQQYDNLPLTFGPGTKVDIKR

>54A1.1_N83D_VH
(SEQ ID NO: 1925)
QVQLVQSGAEVKKPGASVKVSCKASGYTFTSYDINWVRQATGQGLEWMGWMNPH
SGNTGYAQKFQGRVTMTRDTSINTAYMELSSLRSEDTAVYYCAKYNWNYGAFDFW
GQGTMVTVSS

>54A1.1_N83D_VK.03
(SEQ ID NO: 1994)
DIQMAQSPSSLSASVGDRVTITCQASQDISIYLNWYQLKPGKAPKLLIYDVSNLETGV
PSRFSGSGSGTDFTFTISSLQPEDIATYYCQQYDNLPLTFGPGTKVDIKR

TABLE 16-continued

Exemplary Substitutions

>54A1.1_N83D_VH
(SEQ ID NO: 1925)
QVQLVQSGAEVKKPGASVKVSCKASGYTFTSYDINWVRQATGQGLEWMGWMNPH
SGNTGYAQKFQGRVTMTRDTSINTAYMELSSLRSEDTAVYYCAKYNWNYGAFDFW
GQGTMVTVSS

>54A1.1_N83D_VK.04
(SEQ ID NO: 1995)
DIQMAQSPSSLSASVGDRVTITCQASQDISIYLNWYQLKPGKAPKLLIYDVSNLETGV
PSRFSGGGSGTDFTL TISSLQPEDIATYYCQQYDNLPLTFGPGTKVDIKR

>54A1.1_N83D_VH
(SEQ ID NO: 1925)
QVQLVQSGAEVKKPGASVKVSCKASGYTFTSYDINWVRQATGQGLEWMGWMNPH
SGNTGYAQKFQGRVTMTRDTSINTAYMELSSLRSEDTAVYYCAKYNWNYGAFDFW
GQGTMVTVSS

>54A1.1_N83D_VK.05
(SEQ ID NO: 1996)
DIQMAQSPSSLSASVGDRVTITCQASQDISIYLNWYQLKPGKAPKLLIYDVSNLETGV
PSRFSGGGSGTDFTFTISSLQPEDF ATYYCQQYDNLPLTFGPGTKVDIKR

>54A1.1_N83D_VH
(SEQ ID NO: 1925)
QVQLVQSGAEVKKPGASVKVSCKASGYTFTSYDINWVRQATGQGLEWMGWMNPH
SGNTGYAQKFQGRVTMTRDTSINTAYMELSSLRSEDTAVYYCAKYNWNYGAFDFW
GQGTMVTVSS

>54A1.1_N83D_VK.06
(SEQ ID NO: 1997)
DIQMAQSPSSLSASVGDRVTITCQASQDISIYLNWYQLKPGKAPKLLIYDVSNLETGV
PSRFSGGGSGTDFTFTISSLQPEDV ATYYCQQYDNLPLTFGPGTKVDIKR

>54A1.1_N83D_VH
(SEQ ID NO: 1925)
QVQLVQSGAEVKKPGASVKVSCKASGYTFTSYDINWVRQATGQGLEWMGWMNPH
SGNTGYAQKFQGRVTMTRDTSINTAYMELSSLRSEDTAVYYCAKYNWNYGAFDFW
GQGTMVTVSS

>54A1.1_N83D_VK.07
(SEQ ID NO: 1998)
DIQMAQSPSSLSASVGDRVTITCQASQDISIYLNWYQLKPGKAPKLLIYDVSNLETGV
PSRFSGGGSGTDFTFTISSLQPEDIATYYCQQYDNLPLTFGGGTKVDIKR

>54A1.1_N83D_VH
(SEQ ID NO: 1925)
QVQLVQSGAEVKKPGASVKVSCKASGYTFTSYDINWVRQATGQGLEWMGWMNPH
SGNTGYAQKFQGRVTMTRDTSINTAYMELSSLRSEDTAVYYCAKYNWNYGAFDFW
GQGTMVTVSS

>54A1.1_N83D_VK.08
(SEQ ID NO: 1999)
DIQMAQSPSSLSASVGDRVTITCQASQDISIYLNWYQLKPGKAPKLLIYDVSNLETGV
PSRFSGGGSGTDFTFTISSLQPEDIATYYCQQYDNLPLTFGQGTKVDIKR

>54A1.1_N83D_VH
(SEQ ID NO: 1925)
QVQLVQSGAEVKKPGASVKVSCKASGYTFTSYDINWVRQATGQGLEWMGWMNPH
SGNTGYAQKFQGRVTMTRDTSINTAYMELSSLRSEDTAVYYCAKYNWNYGAFDFW
GQGTMVTVSS

>54A1.1_N83D_VK
(SEQ ID NO: 1924)
DIQMAQSPSSLSASVGDRVTITCQASQDISIYLNWYQLKPGKAPKLLIYDVSNLETGV
PSRFSGGGSGTDFTFTISSLQPEDIATYYCQQYDNLPLTFGPGTKVDIKR

>54A1.1_N83D_VH.09
(SEQ ID NO: 2000)
QVQLVQSGAEVKKPGASVKVSCKASGYTFTSYDINWVRQAPGQGLEWMGWMNPH
SGNTGYAQKFQGRVTMTRDTSINTAYMELSSLRSEDTAVYYCAKYNWNYGAFDFW
GQGTMVTVSS

>54A1.1_N83D_VK
(SEQ ID NO: 1924)
DIQMAQSPSSLSASVGDRVTITCQASQDISIYLNWYQLKPGKAPKLLIYDVSNLETGV
PSRFSGGGSGTDFTFTISSLQPEDIATYYCQQYDNLPLTFGPGTKVDIKR

TABLE 16-continued

Exemplary Substitutions

>54A1.1_N83D_VH.I0
(SEQ ID NO: 2001)
QVQLVQSGAEVKKPGASVKVSCKASGYTFTSYDINWVRQATGQGLEWMGYMNPH
SGNTGYAQKFQGRVTMTRDTSINTAYMELSSLRSEDTAVYYCAKYNWNYGAFDFW
GQGTMVTVSS

>54A1.1_N83D_VK
(SEQ ID NO: 1924)
DIQMAQSPSSLSASVGDRVTITCQASQDISIYLNWYQLKPGKAPKLLIYDVSNLETGV
PSRFSGGGSGTDFTFTISSLQPEDIATYYCQQYDNLPLTFGPGTKVDIKR

>54A1.1_N83D_VH.11
(SEQ ID NO: 2002)
QVQLVQSGAEVKKPGASVKVSCKASGYTFTSYDINWVRQATGQGLEWMGWMNPH
SGNTGY AQKFQGRVTMTRDTSINTA YMELSSLRSEDTAVYYCAKYNYNYGAFDFW
GQGTMVTVSS

>58C2.1_VK.01
(SEQ ID NO: 2003)
ENMTQTPLSLPVTPGEP ASISCRSSQSLFDNDEGDTYLDWYLQKPGQSPQLLIYTLSY
RASGVPDRFSGSGSGTDFTLKISRVEAEDVGVYYCMQRLEFPITFGQGTRLEIKR

>58C2.1_VH
(SEQ ID NO: 1929)
QVQL VESGGGVVQPGRSLRLSCAASGFTFSNYGMHWVRQAPGKGLEWVAVIWND
GNNKYYADSVKGRFTISRDNSKNTLYLQMNSLRAEDTAVYYCARDQNYDFWNGYP
YYFYYGMDVWGQGTTVTVSS

>58C2.1_VK
(SEQ ID NO: 1928)
ENMTQTPLSLPVTPGEPASISCRSSQSLFDNDDGDTYLDWYLQKPGQSPQLLIYTLSY
RASGVPDRFSGSGSGTDFTLKISRVEAEDVGVYYCMQRLEFPITFGQGTRLEIKR

>58C2.1_VH.02
(SEQ ID NO: 2004)
QVQLVESGGGVVQPGGSLRLSCAASGFTFSNYGMHWVRQAPGKGLEWVAVIWND
GNNKYYADSVKGRFTISRDNSKNTLYLQMNSLRAEDTAVYYCARDQNYDFWNGYP
YYFYYGMDVWGQGTTVTVSS

>58C2.1_VK
(SEQ ID NO: 1928)
ENMTQTPLSLPVTPGEPASISCRSSQSLFDNDDGDTYLDWYLQKPGQSPQLLIYTLSY
RASGVPDRFSGSGSGTDFTLKISRVEAEDVGVYYCMQRLEFPITFGQGTRLEIKR

>58C2.1_VH.03
(SEQ ID NO: 2005)
QVQLVESGGGVVQPGRSLRLSCAASGFTFSNYGMHWVRQAPGKGLEWVAVIWNEG
NNKYYADSVKGRFTISRDNSKNTLYLQMNSLRAEDTAVYYCARDQNYDFWNGYPY
YFYYGMDVWGQGTTVTVSS

>58C2.1_VK
(SEQ ID NO: 1928)
ENMTQTPLSLPVTPGEPASISCRSSQSLFDNDDGDTYLDWYLQKPGQSPQLLIYTLSY
RASGVPDRFSGSGSGTDFTLKISRVEAEDVGVYYCMQRLEFPITFGQGTRLEIKR

>58C2.1_VH.04
(SEQ ID NO: 2006)
QVQLVESGGGVVQPGRSLRLSCAASGFTFSNYGMHWVRQAPGKGLEWVAVIWND
GNNKYYAESVKGRFTISRDNSKNTLYLQMNSLRAEDTAVYYCARDQNYDFWNGYP
YYFYYGMDVWGQGTTVTVSS

>58C2.1_VK
(SEQ ID NO: 1928)
ENMTQTPLSLPVTPGEPASISCRSSQSLFDNDDGDTYLDWYLQKPGQSPQLLIYTLSY
RASGVPDRFSGSGSGTDFTLKISRVEAEDVGVYYCMQRLEFPITFGQGTRLEIKR

>58C2.1_VH.05
(SEQ ID NO: 2007)
QVQL VESGGGVVQPGRSLRLSCAASGFTFSNYGMHWVRQAPGKGLEWVAVIWND
GNNKYY ADSVKGRFTISRDNSKNTLYLQMNSLRAEDTAVYYCARDQNYDFWQGYP
YYFYYGMDVWGQGTTVTVSS

>56E7.3_VK.01
(SEQ ID NO: 2008)
DLQMTQSPSSLSASVGDRVTITCQASQDIKKFLNWYQQKPGKAPKLLIYDASNLETG
VPSRFSGSGSGTDFTFTISSLQPEDIA TYYCQQY AILPFTFGPGTTVDIKR

TABLE 16-continued

Exemplary Substitutions

>56E7.3_VH
(SEQ ID NO: 1927)
EVQLVQSGPEVKKPGESLKISCKGSGYSLTSYWIGWVRQMPGKGLEWMGIIYPGDS
DTRYSPSFQGQVTISADTSISTA YLQWSRLKASDTA VYYCARAQLGIFDYWGQGTLV
TVSS

>56E7.3_VK.02
(SEQ ID NO: 2009)
DLQMTQSPSSLSASVGDRVTITCQASQDIKKFLNWYQQKPGKAPNLLIYDASNLETG
VPSRFSGSGSGTDFTLTISSLQPEDIATYYCQQYAILPFTFGPGTTVDIKR

>56E7.3_VH
(SEQ ID NO: 1927)
EVQLVQSGPEVKKPGESLKISCKGSGYSLTSYWIGWVRQMPGKGLEWMGIIYPGDS
DTRYSPSFQGQVTISADTSISTAYLQWSRLKASDTAVYYCARAQLGIFDYWGQGTLV
TVSS

>56E7.3_VK.03
(SEQ ID NO: 2010)
DLQMTQSPSSLSASVGDRVTITCQASQDIKKFLNWYQQKPGKAPNLLIYDASNLETG
VPSRFSGSGSGTDFTFTISSLQPEDF ATYYCQQY AILPFTFGPGTTVDIKR

>56E7.3_VH
(SEQ ID NO: 1927)
EVQLVQSGPEVKKPGESLKISCKGSGYSLTSYWIGWVRQMPGKGLEWMGIIYPGDS
DTRYSPSFQGQVTISADTSISTAYLQWSRLKASDTAVYYCARAQLGIFDYWGQGTLV
TVSS

>56E7.3_VK.04
(SEQ ID NO: 2011)
DLQMTQSPSSLSASVGDRVTITCQASQDIKKFLNWYQQKPGKAPNLLIYDASNLETG
VPSRFSGSGSGTDFTFTISSLQPEDIATYYCQQY AILPFTFGGGTTVDIKR

>56E7.3_VH
(SEQ ID NO: 1927)
EVQLVQSGPEVKKPGESLKISCKGSGYSLTSYWIGWVRQMPGKGLEWMGIIYPGDS
DTRYSPSFQGQVTISADTSISTAYLQWSRLKASDTAVYYCARAQLGIFDYWGQGTLV
TVSS

>56E7.3_VK.05
(SEQ ID NO: 2012)
DLQMTQSPSSLSASVGDRVTITCQASQDIKKFLNWYQQKPGKAPNLLIYDASNLETG
VPSRFSGSGSGTDFTFTISSLQPEDIATYYCQQYAILPFTFGQGTTVDIKR

>56E7.3_VH
(SEQ ID NO: 1927)
EVQLVQSGPEVKKPGESLKISCKGSGYSLTSYWIGWVRQMPGKGLEWMGIIYPGDS
DTRYSPSFQGQVTISADTSISTAYLQWSRLKASDTA VYYCARAQLGIFDYWGQGTLV
TVSS

>56E7.3_VK.06
(SEQ ID NO: 2013)
DLQMTQSPSSLSASVGDRVTITCQASQDIKKFLNWYQQKPGKAPNLLIYDASNLETG
VPSRFSGSGSGTDFTFTISSLQPEDIATYYCQQYAILPFTFGPGTKVDIKR

>56E7.3_VH
(SEQ ID NO: 1927)
EVQLVQSGPEVKKPGESLKISCKGSGYSLTSYWIGWVRQMPGKGLEWMGIIYPGDS
DTRYSPSFQGQVTISADTSISTAYLQWSRLKASDTAVYYCARAQLGIFDYWGQGTLV
TVSS

>56E7.3_VK.07
(SEQ ID NO: 2014)
DLQMTQSPSSLSASVGDRVTITCQASQDIKKFLNWYQQKPGKAPNLLIYDASNLETG
VPSRFSGSGSGTDFTFTISSLQPEDIATYYCQQYAILPFTFGPGTRVDIKR

>56E7.3_VH
(SEQ ID NO: 1927)
EVQLVQSGPEVKKPGESLKISCKGSGYSLTSYWIGWVRQMPGKGLEWMGIIYPGDS
DTRYSPSFQGQVTISADTSISTA YLQWSRLKASDTAVYYCARAQLGIFDYWGQGTLV
TVSS

>56E7.3_VK
(SEQ ID NO: 1926)
DLQMTQSPSSLSASVGDRVTITCQASQDIKKFLNWYQQKPGKAPNLLIYDASNLETG
VPSRFSGSGSGTDFTFTISSLQPEDIATYYCQQYAILPFTFGPGTTVDIKR

TABLE 16-continued

Exemplary Substitutions

>56E7.3_VH.08
(SEQ ID NO: 2015)
EVQLVQSGPEVKKPGESLKISCKGSGYSFTSYWIGWVRQMPGKGLEWMGIIYPGDSD
TRYSPSFQGQVTISADTSISTA YLQWSRLKASDTAVYYCARAQLGIFDYWGQGTLVT
VSS

>56E7.3_VK.10
(SEQ ID NO: 1926)
DLQMTQSPSSLSASVGDRVTITCQASQDIKKFLNWYQQKPGKAPNLLIYDASNLETG
VPSRFSGSGSGTDFTFTISSLQPEDIATYYCQQYAILPFTFGPGTTVDIKR

>56E7.3_VH.09
(SEQ ID NO: 2016)
EVQLVQSGPEVKKPGESLKISCKGSGYSLTSYWIGWVRQMPGKGLEWMGIIYPGESD
TRYSPSFQGQVTISADTSISTAYLQWSRLKASDTAVYYCARAQLGIFDYWGQGTLVT
VSS

>56E7.3_VK
(SEQ ID NO: 1926)
DLQMTQSPSSLSASVGDRVTITCQASQDIKKFLNWYQQKPGKAPNLLIYDASNLETG
VPSRFSGSGSGTDFTFTISSLQPEDIATYYCQQYAILPFTFGPGTTVDIKR

>56E7.3_VH.I0
(SEQ ID NO: 2017)
EVQLVQSGPEVKKPGESLKISCKGSGYSLTSYWIGWVRQMPGKGLEWMGIIYPGDS
DTRYSPSFQGQVTISADKSISTA YLQWSRLKASDTAVYYCARAQLGIFDYWGQGTLV
TVSS

>56E7.3_VK
(SEQ ID NO: 1926)
DLQMTQSPSSLSASVGDRVTITCQASQDIKKFLNWYQQKPGKAPNLLIYDASNLETG
VPSRFSGSGSGTDFTFTISSLQPEDIATYYCQQYAILPFTFGPGTTVDIKR

>56E7.3_VH.11
(SEQ ID NO: 2018)
EVQLVQSGPEVKKPGESLKISCKGSGYSLTSYWIGWVRQMPGKGLEWMGIIYPGDS
DTRYSPSFQGQVTISADTSISTAYLQWSSLKASDTAVYYCARAQLGIFDYWGQGTLV
TVSS

>60D7.1_N30T_VK.01
(SEQ ID NO: 2019)
DIVLTQTPLSLPVTPGEPASISCRSSQSLLESDDGDTYLDWYLQKPGQSPQLLIYTLSY
RASGVPDRFSGSGSGTDFTLKISRVEAEDVGVYYCMQRIEFPLTFGGGTKVEIKR

>60D7.1_N30T_VH
(SEQ ID NO: 1931)
QVQL VESGGGVVQPGRSLRLSCAASGFTFSSYGMHWVRQAPGKGLEWV A VIWYDG
SNKYY ADSVKGRFTISRDNSKNTL YLQMNSLRAEDTA VFYCARDQYFDFWSGYPFF
YYYGMDVWGQGTTVTVSS

>60D7.1_N30T_VK.02
(SEQ ID NO: 2020)
DIVLTQTPLSLPVTPGEPASISCRSSQSLLDSDEGDTYLDWYLQKPGQSPQLLIYTLSY
RASGVPDRFSGSGSGTDFTLKISRVEAEDVGVYYCMQRIEFPLTFGGGTKVEIKR

>60D7.1_N30T_VH
(SEQ ID NO: 1931)
QVQLVESGGGVVQPGRSLRLSCAASGFTFSSYGMHWVRQAPGKGLEWVAVIWYDG
SNKYYADSVKGRFTISRDNSKNTLYLQMNSLRAEDTAVFYCARDQYFDFWSGYPFF
YYYGMDVWGQGTTVTVSS

>60D7.1_N30T_VK
(SEQ ID NO: 2021)
DIVLTQTPLSLPVTPGEPASISCRSSQSLLDSDDGDTYLDWYLQKPGQSPQLLIYTLSY
RASGVPDRFSGSGSGTDFTLKISRVEAEDVGVYYCMQRIEFPLTFGGGTKVEIKR

>60D7.1_N30T_VH.03
(SEQ ID NO: 2022)
QVQLVESGGGVVQPGGSLRLSCAASGFTFSSYGMHWVRQAPGKGLEWVAVIWYDG
SNKYYADSVKGRFTISRDNSKNTLYLQMNSLRAEDTAVFYCARDQYFDFWSGYPFF
YYYGMDVWGQGTTVTVSS

>60D7.1_N30T_VK
(SEQ ID NO: 2021)
DIVLTQTPLSLPVTPGEPASISCRSSQSLLDSDDGDTYLDWYLQKPGQSPQLLIYTLSY
RASGVPDRFSGSGSGTDFTLKISRVEAEDVGVYYCMQRIEFPLTFGGGTKVEIKR

TABLE 16-continued

Exemplary Substitutions

>60D7.1_N30T_VH.04
(SEQ ID NO: 2023)
QVQLVESGGGVVQPGRSLRLSCAASGFTFSSYGMHWVRQAPGKGLEWVAVIWYEG
SNKYYADSVKGRFTISRDNSKNTLYLQMNSLRAEDTAVFYCARDQYFDFWSGYPFF
YYYGMDVWGQGTTVTVSS

>60D7.1_N30T_VK
(SEQ ID NO: 2021)
DIVLTQTPLSLPVTPGEPASISCRSSQSLLDSDDGDTYLDWYLQKPGQSPQLLIYTLSY
RASGVPDRFSGSGSGTDFTLKISRVEAEDVGVYYCMQRIEFPLTFGGGTKVEIKR

>60D7.1_N30T_VH.05
(SEQ ID NO: 2024)
QVQLVESGGGVVQPGRSLRLSCAASGFTFSSYGMHWVRQAPGKGLEWVAVIWYDG
SNKYYAESVKGRFTISRDNSKNTLYLQMNSLRAEDTAVFYCARDQYFDFWSGYPFF
YYYGMDVWGQGTTVTVSS

>60D7.1_N30T_VK
(SEQ ID NO: 2021)
DIVLTQTPLSLPVTPGEPASISCRSSQSLLDSDDGDTYLDWYLQKPGQSPQLLIYTLSY
RASGVPDRFSGSGSGTDFTLKISRVEAEDVGVYYCMQRIEFPLTFGGGTKVEIKR

>60D7.1_N30T_VH.06
(SEQ ID NO: 2025)
QVQLVESGGGVVQPGRSLRLSCAASGFTFSSYGMHWVRQAPGKGLEWVAVIWYDG
SNKYYADSVKGRFTISRDNSKNTLYLQMNSLRAEDTAVFYCARDQYFDFYSGYPFF
YYYGMDVWGQGTTVTVSS

>63A10.1_C58S_VL.01
(SEQ ID NO: 2026)
SYELTQPLSVSVATAQMARITCGGNNIGSKAVHWYQQKPGQDPVLVIYSDSNRPSGI
PERFSGSNPGNTATL TISRIEAGDEADYYCQVWDSSSDGVFGGGTKLTVLG

>63A10.1_C58S_VH
(SEQ ID NO: 1933)
EVQLVESGGDL VKPGGSLRLSCA VSGITFSNA WMSWVRQAPGKGLEWVGRIKSKTD
GGTTDYAAPVKGRFTVSRDGSKNTLYLQMNSLKTEDTAVYYCTTDSSGSYYVEDYF
DYWGQGTLVTVSS

>63A10.1_C58S_VL.02
(SEQ ID NO: 2027)
SYELTQPPSVSVATAQMARITCGGNNIGSKA VHWYQQKPGQDPVLVIYSDSNRPSGI
PERFSGSNPGNTATL TISRIEAGDEADYYCQVWDSSSDGVFGGGTKLTVLG

>63A10.1_C58S_VH
(SEQ ID NO: 1933)
EVQLVESGGDLVKPGGSLRLSCAVSGITFSNAWMSWVRQAPGKGLEWVGRIKSKTD
GGTTDYAAPVKGRFTVSRDGSKNTLYLQMNSLKTEDTAVYYCTTDSSGSYYVEDYF
DYWGQGTLVTVSS

>63A10.1_C58S_VL.03
(SEQ ID NO: 2028)
SYELTQPHSVSV ALAQMARITCGGNNIGSKAVHWYQQKPGQDPVLVIYSDSNRPSGI
PERFSGSNPGNTATLTISRIEAGDEADYYCQVWDSSSDGVFGGGTKLTVLG

>63A10.1_C58S_VH
(SEQ ID NO: 1933)
EVQLVESGGDLVKPGGSLRLSCAVSGITFSNAWMSWVRQAPGKGLEWVGRIKSKTD
GGTTDYAAPVKGRFTVSRDGSKNTLYLQMNSLKTEDTAVYYCTTDSSGSYYVEDYF
DYWGQGTLVTVSS

>63A10.1_C58S_VL.04
(SEQ ID NO: 2029)
SYELTQPHSVSVAPAQMARITCGGNNIGSKAVHWYQQKPGQDPVLVIYSDSNRPSGI
PERFSGSNPGNTATLTISRIEAGDEADYYCQVWDSSSDGVFGGGTKLTVLG

>63A10.1_C58S_VH
(SEQ ID NO: 1933)
EVQLVESGGDLVKPGGSLRLSCAVSGITFSNAWMSWVRQAPGKGLEWVGRIKSKTD
GGTTDYAAPVKGRFTVSRDGSKNTLYLQMNSLKTEDTAVYYCTTDSSGSYYVEDYF
DYWGQGTLVTVSS

>63A10.1_C58S_VL.05
(SEQ ID NO: 2030)
SYELTQPHSVSVATGQMARITCGGNNIGSKAVHWYQQKPGQDPVLVIYSDSNRPSGI
PERFSGSNPGNTATLTISRIEAGDEADYYCQVWDSSSDGVFGGGTKLTVLG

TABLE 16-continued

Exemplary Substitutions

>63A10.1_C58S_VH
(SEQ ID NO: 1933)
EVQLVESGGDLVKPGGSLRLSCAVSGITFSNAWMSWVRQAPGKGLEWVGRIKSKTD
GGTTDYAAPVKGRFTVSRDGSKNTLYLQMNSLKTEDTAVYYCTTDSSGSYYVEDYF
DYWGQGTLVTVSS

>63A10.1_C58S_VL.06
(SEQ ID NO: 2031)
SYELTQPHSVSV ATAQTARITCGGNNIGSKA VHWYQQKPGQDPVLVIYSDSNRPSGIP
ERFSGSNPGNTATL TISRIEAGDEADYYCQVWDSSSDGVFGGGTKL TVLG

>63A10.1_C58S_VH
(SEQ ID NO: 1933)
EVQLVESGGDL VKPGGSLRLSCA VSGITFSNA WMSWVRQAPGKGLEWVGRIKSKTD
GGTTDYAAPVKGRFTVSRDGSKNTLYLQMNSLKTEDTAVYYCTTDSSGSYYVEDYF
DYWGQGTLVTVSS

>63A10.1_C58S_VL.07
(SEQ ID NO: 2032)
SYELTQPHSVSVATAQMARITCGGNNIGSKAVHWYQQKPGQAPVLVIYSDSNRPSGI
PERFSGSNPGNTATLTISRIEAGDEADYYCQVWDSSSDGVFGGGTKLTVLG

>63A10.1_C58S_VH
(SEQ ID NO: 1933)
EVQLVESGGDLVKPGGSLRLSCAVSGITFSNAWMSWVRQAPGKGLEWVGRIKSKTD
GGTTDYAAPVKGRFTVSRDGSKNTLYLQMNSLKTEDTAVYYCTTDSSGSYYVEDYF
DYWGQGTLVTVSS

>63A10.1_C58S_VL.08
(SEQ ID NO: 2033)
SYELTQPHSVSVATAQMARITCGGNNIGSKAVHWYQQKPGQSPVLVIYSDSNRPSGI
PERFSGSNPGNTATL TISRIEAGDEADYYCQVWDSSSDGVFGGGTKLTVLG

>63A10.1_C58S_VH
(SEQ ID NO: 1933)
EVQLVESGGDLVKPGGSLRLSCAVSGITFSNAWMSWVRQAPGKGLEWVGRIKSKTD
GGTTDYAAPVKGRFTVSRDGSKNTLYLQMNSLKTEDTAVYYCTTDSSGSYYVEDYF
DYWGQGTLVTVSS

>63A10.1_C58S_VL.09
(SEQ ID NO: 2034)
SYELTQPHSVSVATAQMARITCGGNNIGSKAVHWYQQKPGQFPVLVIYSDSNRPSGI
PERFSGSNPGNTATLTISRIEAGDEADYYCQVWDSSSDGVFGGGTKLTVLG

>63A10.1_C58S_VH
(SEQ ID NO: 1933)
EVQLVESGGDLVKPGGSLRLSCAVSGITFSNAWMSWVRQAPGKGLEWVGRIKSKTD
GGTTDYAAPVKGRFTVSRDGSKNTLYLQMNSLKTEDTAVYYCTTDSSGSYYVEDYF
DYWGQGTLVTVSS

>63A10.1_C58S_VL.10
(SEQ ID NO: 2035)
SYELTQPHSVSVATAQMARITCGGNNIGSKAVHWYQQKPGQDPVLVIYSESNRPSGI
PERFSGSNPGNTATLTISRIEAGDEADYYCQVWDSSSDGVFGGGTKLTVLG

>63A10.1_C58S_VH
(SEQ ID NO: 1933)
EVQLVESGGDLVKPGGSLRLSCAVSGITFSNAWMSWVRQAPGKGLEWVGRIKSKTD
GGTTDYAAPVKGRFTVSRDGSKNTLYLQMNSLKTEDTAVYYCTTDSSGSYYVEDYF
DYWGQGTLVTVSS

>63A10.1_C58S_VL.11
(SEQ ID NO: 2036)
SYELTQPHSVSVATAQMARITCGGNNIGSKAVHWYQQKPGQDPVLVIYSDSNRPSGI
PERFSGSNSGNTATLTISRIEAGDEADYYCQVWDSSSDGVFGGGTKLTVLG

>63A10.1_C58S_VH
(SEQ ID NO: 1933)
EVQLVESGGDLVKPGGSLRLSCAVSGITFSNAWMSWVRQAPGKGLEWVGRIKSKTD
GGTTDYAAPVKGRFTVSRDGSKNTLYLQMNSLKTEDTAVYYCTTDSSGSYYVEDYF
DYWGQGTLVTVSS

>63A10.1_C58S_VL.12
(SEQ ID NO: 2037)
SYELTQPHSVSVATAQMARITCGGNNIGSKAVHWYQQKPGQDPVLVIYSDSNRPSGI
PERFSGSNPGNTATLTISRIQAGDEADYYCQVWDSSSDGVFGGGTKLTVLG

TABLE 16-continued

Exemplary Substitutions

>63A10.1_C58S_VH
(SEQ ID NO: 1933)
EVQLVESGGDLVKPGGSLRLSCAVSGITFSNAWMSWVRQAPGKGLEWVGRIKSKTD
GGTTDYAAPVKGRFTVSRDGSKNTLYLQMNSLKTEDTAVYYCTTDSSGSYYVEDYF
DYWGQGTLVTVSS

>63A10.1_C58S_VL.13
(SEQ ID NO: 2038)
SYELTQPHSVSVATAQMARITCGGNNIGSKAVHWYQQKPGQDPVLVIYSDSNRPSGI
PERFSGSNPGNTATLTISRIEAGDEADYYCQVWESSSDGVFGGGTKLTVLG

>63A10.1_C58S_VH
(SEQ ID NO: 1933)
EVQLVESGGDLVKPGGSLRLSCAVSGITFSNAWMSWVRQAPGKGLEWVGRIKSKTD
GGTTDYAAPVKGRFTVSRDGSKNTLYLQMNSLKTEDTAVYYCTTDSSGSYYVEDYF
DYWGQGTLVTVSS

>63A10.1_C58S_VL.14
(SEQ ID NO: 2039)
SYELTQPHSVSVATAQMARITCGGNNIGSKAVHWYQQKPGQDPVLVIYSDSNRPSGI
PERFSGSNPGNTATLTISRIEAGDEADYYCQVWDSSSEGVFGGGTKLTVLG

>63A10.1_C58S_VH
(SEQ ID NO: 1933)
EVQLVESGGDLVKPGGSLRLSCAVSGITFSNAWMSWVRQAPGKGLEWVGRIKSKTD
GGTTDYAAPVKGRFTVSRDGSKNTLYLQMNSLKTEDTAVYYCTTDSSGSYYVEDYF
DYWGQGTLVTVSS

>63A10_C58S_VL
(SEQ ID NO: 1932)
SYELTQPHSVSVATAQMARITCGGNNIGSKAVHWYQQKPGQDPVLVIYSDSNRPSGI
PERFSGSNPGNTATLTISRIEAGDEADYYCQVWDSSSDGVFGGGTKLTVLG

>63A10.1_C58S_VH.15
(SEQ ID NO: 2040)
EVQLVESGGGLVKPGGSLRLSCAVSGITFSNAWMSWVRQAPGKGLEWVGRIKSKTD
GGTTDYAAPVKGRFTVSRDGSKNTLYLQMNSLKTEDTAVYYCTTDSSGSYYVEDYF
DYWGQGTLVTVSS

>63A10.1_C58S_VL
(SEQ ID NO: 1932)
SYELTQPHSVSVATAQMARITCGGNNIGSKAVHWYQQKPGQDPVLVIYSDSNRPSGI
PERFSGSNPGNTATLTISRIEAGDEADYYCQVWDSSSDGVFGGGTKLTVLG

>63A10.1_C58S_VH.16
(SEQ ID NO: 2041)
EVQLVESGGDLVQPGGSLRLSCAVSGITFSNAWMSWVRQAPGKGLEWVGRIKSKTD
GGTTDYAAPVKGRFTVSRDGSKNTLYLQMNSLKTEDTAVYYCTTDSSGSYYVEDYF
DYWGQGTLVTVSS

>63A10.1_C58S_VL
(SEQ ID NO: 1932)
SYELTQPHSVSVATAQMARITCGGNNIGSKAVHWYQQKPGQDPVLVIYSDSNRPSGI
PERFSGSNPGNTATLTISRIEAGDEADYYCQVWDSSSDGVFGGGTKLTVLG

>63A10.1_C58S_VH.17
(SEQ ID NO: 2042)
EVQLVESGGDLVKPGGSLRLSCAVSGFTFSNAWMSWVRQAPGKGLEWVGRIKSKT
DGGTTDYAAPVKGRFTVSRDGSKNTLYLQMNSLKTEDTAVYYCTTDSSGSYYVED
YFDYWGQGTLVTVSS

>63A10.1_C58S_VL
(SEQ ID NO: 1932)
SYELTQPHSVSVATAQMARITCGGNNIGSKAVHWYQQKPGQDPVLVIYSDSNRPSGI
PERFSGSNPGNTATLTISRIEAGDEADYYCQVWDSSSDGVFGGGTKLTVLG

>63A10.1_C58S_VH.18
(SEQ ID NO: 2043)
EVQLVESGGDLVKPGGSLRLSCAVSGITFSNAWMSWVRQAPGKGLEWVSRIKSKTD
GGTTDYAAPVKGRFTVSRDGSKNTLYLQMNSLKTEDTAVYYCTTDSSGSYYVEDYF
DYWGQGTLVTVSS

>63A10.1_C58S_VL
(SEQ ID NO: 1932)
SYELTQPHSVSVATAQMARITCGGNNIGSKAVHWYQQKPGQDPVLVIYSDSNRPSGI
PERFSGSNPGNTATLTISRIEAGDEADYYCQVWDSSSDGVFGGGTKLTVLG

TABLE 16-continued

Exemplary Substitutions

>63A10.1_C58S_VH.19
(SEQ ID NO: 2044)
EVQLVESGGDLVKPGGSLRLSCAVSGITFSNAWMSWVRQAPGKGLEWVGRIKSKTE
GGTTDYAAPVKGRFTVSRDGSKNTLYLQMNSLKTEDTAVYYCTTDSSGSYYVEDYF
DYWGQGTLVTVSS

>63A10.1_C58S_VL
(SEQ ID NO: 1932)
SYELTQPHSVSVATAQMARITCGGNNIGSKAVHWYQQKPGQDPVLVIYSDSNRPSGI
PERFSGSNPGNTATLTISRIEAGDEADYYCQVWDSSSDGVFGGGTKLTVLG

>63A10.1_C58S_VH.20
(SEQ ID NO: 2045)
EVQLVESGGDLVKPGGSLRLSCAVSGITFSNAWMSWVRQAPGKGLEWVGRIKSKTD
GGTTDYAAPVKGRFTVSRDDSKNTLYLQMNSLKTEDTAVYYCTTDSSGSYYVEDYF
DYWGQGTLVTVSS

>63A10.1_C58S_VL
(SEQ ID NO: 1932)
SYELTQPHSVSVATAQMARITCGGNNIGSKAVHWYQQKPGQDPVLVIYSDSNRPSGI
PERFSGSNPGNTATLTISRIEAGDEADYYCQVWDSSSDGVFGGGTKLTVLG

>63A10.1_C58S_VH.21
(SEQ ID NO: 2046)
EVQLVESGGDLVKPGGSLRLSCAVSGITFSNAWMSWVRQAPGKGLEWVGRIKSKTD
GGTTDYAAPVKGRFTVSRDNSKNTLYLQMNSLKTEDTAVYYCTTDSSGSYYVEDYF
DYWGQGTLVTVSS

>63A10.1_C58S_VL
(SEQ ID NO: 1932)
SYELTQPHSVSVATAQMARITCGGNNIGSKAVHWYQQKPGQDPVLVIYSDSNRPSGI
PERFSGSNPGNTATLTISRIEAGDEADYYCQVWDSSSDGVFGGGTKLTVLG

>63A10.1_C58S_VH.22
(SEQ ID NO: 2047)
EVQLVESGGDLVKPGGSLRLSCAVSGITFSNAWMSWVRQAPGKGLEWVGRIKSKTD
GGTTDYAAPVKGRFTVSRDGSKNTLYLQMNSLKAEDTAVYYCTTDSSGSYYVEDYF
DYWGQGTLVTVSS

>63A10.1_C58S_VL
(SEQ ID NO: 1932)
SYELTQPHSVSVATAQMARITCGGNNIGSKAVHWYQQKPGQDPVLVIYSDSNRPSGI
PERFSGSNPGNTATLTISRIEAGDEADYYCQVWDSSSDGVFGGGTKLTVLG

>63A10.1_C58S_VH.23
(SEQ ID NO: 2048)
EVQLVESGGDLVKPGGSLRLSCAVSGITFSNAWMSWVRQAPGKGLEWVGRIKSKTD
GGTTDYAAPVKGRFTVSRDGSKNTLYLQMNSLKTEDTAVYYCATDSSGSYYVEDYF
DYWGQGTLVTVSS

>63A10.1_C58S_VL
(SEQ ID NO: 1932)
SYELTQPHSVSVATAQMARITCGGNNIGSKAVHWYQQKPGQDPVLVIYSDSNRPSGI
PERFSGSNPGNTATLTISRIEAGDEADYYCQVWDSSSDGVFGGGTKLTVLG

>63A10.1_C58S_VH.24
(SEQ ID NO: 2049)
EVQLVESGGDLVKPGGSLRLSCAVSGITFSNAWMSWVRQAPGKGLEWVGRIKSKTD
GGTTDYAAPVKGRFTVSRDGSKNTLYLQMNSLKTEDTAVYYCTRDSSGSYYVEDYF
DYWGQGTLVTVSS

>63A10.1_C58S_VL
(SEQ ID NO: 1932)
SYELTQPHSVSVATAQMARITCGGNNIGSKAVHWYQQKPGQDPVLVIYSDSNRPSGI
PERFSGSNPGNTATLTISRIEAGDEADYYCQVWDSSSDGVFGGGTKLTVLG

>63A10.1_C58S_VH.25
(SEQ ID NO: 2050)
EVQLVESGGDLVKPGGSLRLSCAVSGITFSNAWMSWVRQAPGKGLEWVGRIKSKTD
GGTTDYAAPVKGRFTVSRDGSKNTLYLQMNSLKTEDTAVYYCTTESSGSYYVEDYF
DYWGQGTLVTVSS

>63A10.1_C58S_VL.26
(SEQ ID NO: 2051)
SYELTQPHSVSVATAQMARITCGGNNIGSKAVHWYQQKPGQDPVLVIYSDSNRPSGI
PERFSGSNPGNTATLTISRIEAGDEADYYCQVYDSSSDGVFGGGTKLTVLG

TABLE 16-continued

Exemplary Substitutions

>63A10.1_C58S_VH
(SEQ ID NO: 1933)
EVQLVESGGDLVKPGGSLRLSCAVSGITFSNAWMSWVRQAPGKGLEWVGRIKSKTD
GGTTDYAAPVKGRFTVSRDGSKNTLYLQMNSLKTEDTAVYYCTTDSSGSYYVEDYF
DYWGQGTLVTVSS

>63A10.3_N20R_C42S_VL.01
(SEQ ID NO: 2052)
SYELTQPPSVSVSPGQTARITCSGDKLGNRYTSWYQQKPGQSPVLVIYQDSERPSGIP
ERFSGSNSGNTATLTISGTQAMDEADYYCQAWDSTTVVFGGGTKLTVLG

>63A10.3_N20R_C42S_VH
(SEQ ID NO: 1935)
EVQLVESGGDLVKPGGSLRLSCAVSGITFSNAWMSWVRQAPGKGLEWVGRIKSKTD
GGTTDYAAPVKGRFTVSRDGSKNTLYLQMNSLKTEDTAVYYCTTDSSGSYYVEDYF
DYWGQGTLVTVSS

>63A10.3_N20R_C42S_VL.02
(SEQ ID NO: 2053)
SYELTQPPSVSVSPGQTARITCSGDKLGNRYTSWYQQKSGQSPVLVIYQESERPSGIPE
RFSGSNSGNTATLTISGTQAMDEADYYCQAWDSTTVVFGGGTKLTVLG

>63A10.3_N20R_C42S_VH
(SEQ ID NO: 1935)
EVQLVESGGDLVKPGGSLRLSCAVSGITFSNAWMSWVRQAPGKGLEWVGRIKSKTD
GGTTDYAAPVKGRFTVSRDGSKNTLYLQMNSLKTEDTAVYYCTTDSSGSYYVEDYF
DYWGQGTLVTVSS

>63A10.3_N20R_C42S_VL.03
(SEQ ID NO: 2054)
SYELTQPPSVSVSPGQTARITCSGDKLGNRYTSWYQQKSGQSPVLVIYQDSERPSGIP
ERFSGSNSGNTATLTISGTQAMDEADYYCQAWESTTVVFGGGTKLTVLG

>63A10.3_N20R_C42S_VH
(SEQ ID NO: 1935)
EVQLVESGGDLVKPGGSLRLSCAVSGITFSNAWMSWVRQAPGKGLEWVGRIKSKTD
GGTTDYAAPVKGRFTVSRDGSKNTLYLQMNSLKTEDTAVYYCTTDSSGSYYVEDYF
DYWGQGTLVTVSS

>64B10.1_VL.01
(SEQ ID NO: 2055)
QSVLTQPPSVSAAPGQKVTISCSGSSSNIGNNYVAWYQQLPGTAPKLLIYDNDKRPSG
IPDRFSGSKSGTSATLAITGLQTGDEADYYCGTWDSSLSAVVFGGGTKLTVLG

>64B10.1_VH
(SEQ ID NO: 1937)
QIQLLESGPGLVKPSETLSLTCTVSGGSVSSGDYYWSWIRQPPGKGLEWIGFIYYSGG
TNYNPSLKSRVTISIDTSKNQFSLKLNSVTAADTAVYYCARYSSTWDYYYGVDVWG
QGTTVTVSS

>64B10.1_VL.02
(SEQ ID NO: 2056)
QSVLTQPPSVSAAPGQKVTISCSGSSSNIGNNYVAWYQQLPGTAPKLLIYDNDKRPSG
IPDRFSGSKSGTSATLGITGLQTEDEADYYCGTWDSSLSAVVFGGGTKLTVLG

>64B10.1_VH
(SEQ ID NO: 1937)
QIQLLESGPGL VKPSETLSLTCTVSGGSVSSGDYYWSWIRQPPGKGLEWIGFIYYSGG
TNYNPSLKSRVTISIDTSKNQFSLKLNSVTAADTAVYYCARYSSTWDYYYGVDVWG
QGTTVTVSS

>64B10.1_VL.03
(SEQ ID NO: 2057)
QSVLTQPPSVSAAPGQKVTISCSGSSSNIGNNYVAWYQQLPGTAPKLLIYDNDKRPSG
IPDRFSGSKSGTSATLGITGLQTGDEADYYCGTWESSLSAVVFGGGTKLTVLG

>64B10.1_VH
(SEQ ID NO: 1937)
QIQLLESGPGLVKPSETLSLTCTVSGGSVSSGDYYWSWIRQPPGKGLEWIGFIYYSGG
TNYNPSLKSRVTISIDTSKNQFSLKLNSVTAADTAVYYCARYSSTWDYYYGVDVWG
QGTTVTVSS

>64B10.1_VL
(SEQ ID NO: 1936)
QSVLTQPPSVSAAPGQKVTISCSGSSSNIGNNYVAWYQQLPGTAPKLLIYDNDKRPSG
IPDRFSGSKSGTSATLGITGLQTGDEADYYCGTWDSSLSAVVFGGGTKLTVLG

TABLE 16-continued

Exemplary Substitutions

>64B10.1_VH.04
(SEQ ID NO: 2058)
QIQLQESGPGLVKPSETLSLTCTVSGGSVSSGDYYWSWIRQPPGKGLEWIGFIYYSGG
TNYNPSLKSRVTISIDTSKNQFSLKLNSVTAADTAVYYCARYSSTWDYYYGVDVWG
QGTTVTVSS

>64B10.1_VL
(SEQ ID NO: 1935)
QSVLTQPPSVSAAPGQKVTISCSGSSSNIGNNYVAWYQQLPGTAPKLLIYDNDKRPSG
IPDRFSGSKSGTSATLGITGLQTGDEADYYCGTWDSSLSAVVFGGGTKLTVLG

>64B10.1_VH.05
(SEQ ID NO: 2059)
QIQLLESGPGLVKPSETLSLTCTVSGGSVSSGDYYWSWIRQPPGKGLEWIGFIYYSGG
TNYNPSLKSRVTISIDTSKNQFSLKLNSVTAADTAVYYCARYSSTWDYYYGVDVWG
QGTLVTVSS

>64B10.1_VL
(SEQ ID NO: 1935)
QSVLTQPPSVSAAPGQKVTISCSGSSSNIGNNYVAWYQQLPGTAPKLLIYDNDKRPSG
IPDRFSGSKSGTSATLGITGLQTGDEADYYCGTWDSSLSAVVFGGGTKLTVLG

>64B10.1_VH.06
(SEQ ID NO: 2060)
QIQLLESGPGLVKPSETLSLTCTVSGGSVSSGDYYWSWIRQPPGKGLEWIGFIYYSGG
TNYNPSLKSRVTISIDTSKNQFSLKLNSVTAADTAVYYCARYSSTWDYYYGVDVWG
QGTMVTVSS

>64B10.1_VL.07
(SEQ ID NO: 2061)
QSVLTQPPSVSAAPGQKVTISCSGSSSNIGNNYVAWYQQLPGTAPKLLIYDNDKRPSG
IPDRFSGSKSGTSATLGITGLQTGDEADYYCGTYDSSLSAVVFGGGTKLTVLG

>64B10.1_VH
(SEQ ID NO: 1937)
QIQLLESGPGLVKPSETLSLTCTVSGGSVSSGDYYWSWIRQPPGKGLEWIGFIYYSGG
TNYNPSLKSRVTISIDTSKNQFSLKLNSVTAADTAVYYCARYSSTWDYYYGVDVWG
QGTTVTVSS

>64B10.1_VL
(SEQ ID NO: 1935)
QSVLTQPPSVSAAPGQKVTISCSGSSSNIGNNYVAWYQQLPGTAPKLLIYDNDKRPSG
IPDRFSGSKSGTSATLGITGLQTGDEADYYCGTWDSSLSAVVFGGGTKLTVLG

>64B10.1_VH.08
(SEQ ID NO: 2062)
QIQLLESGPGLVKPSETLSLTCTVSGGSVSSGDYYWSWIRQPPGKGLEWIGFIYYSGG
TNYNPSLKSRVTISIDTSKNQFSLKLNSVTAADTAVYYCARYSSTYDYYYGVDVWG
QGTTVTVSS

>66G2_VK.01
(SEQ ID NO: 2063)
DIQMTQSPSSLSASVGDRVTITCRASQGIRNDLGWYQQKPGKAPKLLIYAASNLQSG
VPSRFSGSGSGTKFTLTINSLQPEDFATYYCLQLNGYPLTFGGGTKVEIKR

>66G2_VH
(SEQ ID NO: 1939)
QVQLVESGGGVVQPGRSLRLSCAASGFTFSSYGMHWVRQAPGKGLEWVAGISYDG
SNKNYADSVKGRITISRDNPKNTLYLQMNSLRAEDTAVYYCATTVTKEDYYYGM
DVWGQGTTVTVSS

>66G2_VK.02
(SEQ ID NO: 2064)
DIQMTQSPSSLSASVGDRVTITCRASQGIRNDLGWYQQKPGKAPKRLIYAASNLQSG
VPSRFSGSGSGTEFTLTINSLQPEDFATYYCLQLNGYPLTFGGGTKVEIKR

>66G2_VH
(SEQ ID NO: 1939)
QVQLVESGGGVVQPGRSLRLSCAASGFTFSSYGMHWVRQAPGKGLEWVAGISYDG
SNKNYADSVKGRITISRDNPKNTLYLQMNSLRAEDTAVYYCATTVTKEDYYYGM
DVWGQGTTVTVSS

>66G2_VK.03
(SEQ ID NO: 2065)
DIQMTQSPSSLSASVGDRVTITCRASQGIRNDLGWYQQKPGKAPKRLIYAASNLQSG
VPSRFSGSGSGTDFTLTINSLQPEDFATYYCLQLNGYPLTFGGGTKVEIKR

TABLE 16-continued

Exemplary Substitutions

>66G2_VH
(SEQ ID NO: 1939)
QVQLVESGGGVVQPGRSLRLSCAASGFTFSSYGMHWVRQAPGKGLEWVAGISYDG
SNKNYADSVKGRITISRDNPKNTLYLQMNSLRAEDTAVYYCATTVTKEDYYYGM
DVWGQGTTVTVSS

>66G2_VK.04
(SEQ ID NO: 2066)
DIQMTQSPSSLSASVGDRVTITCRASQGIRNDLGWYQQKPGKAPKRLIYAASNLQSG
VPSRFSGSGSGTKFTLTINSLQPEDFATYYCLQLQGYPLTFGGGTKVEIKR

>66G2_VH
(SEQ ID NO: 1939)
QVQLVESGGGVVQPGRSLRLSCAASGFTFSSYGMHWVRQAPGKGLEWVAGISYDG
SNKNYADSVKGRITISRDNPKNTLYLQMNSLRAEDTAVYYCATTVTKEDYYYGM
DVWGQGTTVTVSS

>66G2_VK
(SEQ ID NO: 1938)
DIQMTQSPSSLSASVGDRVTITCRASQGIRNDLGWYQQKPGKAPKRLIYAASNLQSG
VPSRFSGSGSGTKFTLTINSLQPEDFATYYCLQLNGYPLTFGGGTKVEIKR

>66G2_VH.05
(SEQ ID NO: 2067)
QVQLVESGGGVVQPGGSLRLSCAASGFTFSSYGMHWVRQAPGKGLEWVAGISYDG
SNKNYADSVKGRITISRDNPKNTLYLQMNSLRAEDTAVYYCATTVTKEDYYYGM
DVWGQGTTVTVSS

>66G2_VK
(SEQ ID NO: 1938)
DIQMTQSPSSLSASVGDRVTITCRASQGIRNDLGWYQQKPGKAPKRLIYAASNLQSG
VPSRFSGSGSGTKFTLTINSLQPEDFATYYCLQLNGYPLTFGGGTKVEIKR

>66G2_VH.06
(SEQ ID NO: 2068)
QVQLVESGGGVVQPGRSLRLSCAASGFTFSSYGMHWVRQAPGKGLEWVAGISYEGS
NKNYADSVKGRITISRDNPKNTLYLQMNSLRAEDTAVYYCATTVTKEDYYYGMD
VWGQGTTVTVSS

>66G2_VK
(SEQ ID NO: 1938)
DIQMTQSPSSLSASVGDRVTITCRASQGIRNDLGWYQQKPGKAPKRLIYAASNLQSG
VPSRFSGSGSGTKFTLTINSLQPEDFATYYCLQLNGYPLTFGGGTKVEIKR

>66G2_VH.07
(SEQ ID NO: 2068)
QVQLVESGGGVVQPGRSLRLSCAASGFTFSSYGMHWVRQAPGKGLEWVAGISYDG
SNKNYAESVKGRITISRDNPKNTLYLQMNSLRAEDTAVYYCATTVTKEDYYYGMD
VWGQGTTVTVSS

>66G2_VK
(SEQ ID NO: 1938)
DIQMTQSPSSLSASVGDRVTITCRASQGIRNDLGWYQQKPGKAPKRLIYAASNLQSG
VPSRFSGSGSGTKFTLTINSLQPEDFATYYCLQLNGYPLTFGGGTKVEIKR

>66G2_VH.08
(SEQ ID NO: 2070)
QVQLVESGGGVVQPGRSLRLSCAASGFTFSSYGMHWVRQAPGKGLEWVAGISYDG
SNKNYADSVKGRFTISRDNPKNTLYLQMNSLRAEDTAVYYCATTVTKEDYYYGM
DVWGQGTTVTVSS

>66G2_VK
(SEQ ID NO: 1938)
DIQMTQSPSSLSASVGDRVTITCRASQGIRNDLGWYQQKPGKAPKRLIYAASNLQSG
VPSRFSGSGSGTKFTLTINSLQPEDFATYYCLQLNGYPLTFGGGTKVEIKR

>66G2_VH.09
(SEQ ID NO: 2071)
QVQLVESGGGVVQPGRSLRLSCAASGFTFSSYGMHWVRQAPGKGLEWVAGISYDG
SNKNYADSVKGRITISRDNPKNTLYLQMNSLRAEDTAVYYCAKTVTKEDYYYGM
DVWGQGTTVTVSS

>66G2_VK
(SEQ ID NO: 1938)
DIQMTQSPSSLSASVGDRVTITCRASQGIRNDLGWYQQKPGKAPKRLIYAASNLQSG
VPSRFSGSGSGTKFTLTINSLQPEDFATYYCLQLNGYPLTFGGGTKVEIKR

TABLE 16-continued

Exemplary Substitutions

>66G2_VH.10
(SEQ ID NO: 2072)
QVQLVESGGGVVQPGRSLRLSCAASGFTFSSYGMHWVRQAPGKGLEWVAGISYDG
SNKNYADSVKGRITISRDNPKNTLYLQMNSLRAEDTAVYYCARTVTKEDYYYGM
DVWGQGTTVTVSS

>67F5_VK.01
(SEQ ID NO: 2073)
EIVMTQSPATLSVSPGERVTLSCRASQSVSSNLAWYQQKPGQAPRLLIYGSSNRAIGIP
ARFSGSGSGTEFTL TISSLQSADFAVYNCQQYEIWPWTFGQGTKVEIKR

>67F5_VH
(SEQ ID NO: 1941)
QVQLKESGPGLVKPSETLSLTCTVSGGSISSYYWSWIRQPPGKGLEWIGYIYYSGNTN
YNPSLKSRVTISVDTSKNQFSLKLSSVTAADTAVYYCAREYYYGSGSYYPWGQGTL
VTVSS

>67F5_VK.02
(SEQ ID NO: 2074)
EIVMTQSPATLSVSPGERVTLSCRASQSVSSNLAWYQQKPGQAPRLLIHGSSNRAIGIP
ARFSGSGSGTEFTLTISSLESADFAVYNCQQYEIWPWTFGQGTKVEIKR

>67F5_VH
(SEQ ID NO: 1941)
QVQLKESGPGLVKPSETLSLTCTVSGGSISSYYWSWIRQPPGKGLEWIGYIYYSGNTN
YNPSLKSRVTISVDTSKNQFSLKLSSVTAADTAVYYCAREYYYGSGSYYPWGQGTL
VTVSS

>67F5_VK.03
(SEQ ID NO: 2075)
EIVMTQSPATLSVSPGERVTLSCRASQSVSSNLAWYQQKPGQAPRLLIHGSSNRAIGIP
ARFSGSGSGTEFTL TISSLQPADFAVYNCQQYEIWPWTFGQGTKVEIKR

>67F5_VH
(SEQ ID NO: 1941)
QVQLKESGPGLVKPSETLSLTCTVSGGSISSYYWSWIRQPPGKGLEWIGYIYYSGNTN
YNPSLKSRVTISVDTSKNQFSLKLSSVTAADTAVYYCAREYYYGSGSYYPWGQGTL
VTVSS

>67F5_VK.04
(SEQ ID NO: 2076)
EIVMTQSPATLSVSPGERVTLSCRASQSVSSNLAWYQQKPGQAPRLLIHGSSNRAIGIP
ARFSGSGSGTEFTLTISSLSEDFAVYNCQQYEIWPWTFGQGTKVEIKR

>67F5_VH
(SEQ ID NO: 1941)
QVQLKESGPGLVKPSETLSLTCTVSGGSISSYYWSWIRQPPGKGLEWIGYIYYSGNTN
YNPSLKSRVTISVDTSKNQFSLKLSSVTAADTAVYYCAREYYYGSGSYYPWGQGTL
VTVSS

>67F5_VK.05
(SEQ ID NO: 2077)
EIVMTQSPATLSVSPGERVTLSCRASQSVSSNLAWYQQKPGQAPRLLIHGSSNRAIGIP
ARFSGSGSGTEFTLTISSLQSADFAVYYCQQYEIWPWTFGQGTKVEIKR

>67F5_VH
(SEQ ID NO: 1941)
QVQLKESGPGLVKPSETLSLTCTVSGGSISSYYWSWIRQPPGKGLEWIGYIYYSGNTN
YNPSLKSRVTISVDTSKNQFSLKLSSVT AADTAVYYCAREYYYGSGSYYPWGQGTL
VTVSS

>67F5_VK
(SEQ ID NO: 1940)
EIVMTQSPATLSVSPGERVTLSCRASQSVSSNLAWYQQKPGQAPRLLIHGSSNRAIGIP
ARFSGSGSGTEFTL TISSLQSADFAVYNCQQYEIWPWTFGQGTKVEIKR

>67F5_VH.06
(SEQ ID NO: 2078)
QVQLQESGPGLVKPSETLSLTCTVSGGSISSYYWSWIRQPPGKGLEWIGYIYYSGNTN
YNPSLKSRVTISVDTSKNQFSLKLSSVTAADTAVYYCAREYYYGSGSYYPWGQGTL
VTVSS

>67F5_VK.07
(SEQ ID NO: 2079)
EIVMTQSPATLSVSPGERVTLSCRASQSVSSNLAWYQQKPGQAPRLLIHGSSNRAIGIP
ARFSGSGSGTEFTL TISSLQSADFAVYNCQQYEIYPWTFGQGTKVEIKR

TABLE 16-continued

Exemplary Substitutions

>67F5_VH
(SEQ ID NO: 1941)
QVQLKESGPGLVKPSETLSLTCTVSGGSISSYYWSIRQPPGKGLEWIGYIYYSGNTN
YNPSLKSRVTISVDTSKNQFSLKLSSVTAADTAVYYCAREYYYGSGSYYPWGQGTL
VTVSS

>67F5_VK.08
(SEQ ID NO: 2080)
EIVMTQSPATLSVSPGERVTLSCRASQSVSSNLAWYQQKPGQAPRLLIHGSSNRAIGIP
ARFSGSGSGTEFTL TISSLQSADFAVYNCQQYEIWPYTFGQGTKVEIKR

>67F5_VH
(SEQ ID NO: 1941)
QVQLKESGPGLVKPSETLSLTCTVSGGSISSYYWSIRQPPGKGLEWIGYIYYSGNTN
YNPSLKSRVTISVDTSKNQFSLKLSSVTAADTAVYYCAREYYYGSGSYYPWGQGTL
VTVSS

>67C10_VK.01
(SEQ ID NO: 2081)
DIVMTQTPLSLPVTPGEPASISCRSSQSLLNSDDGNTYLDWYLQKPGQSPQLLIYTLSY
RASGVPDRFSGSGSGTDFTLKISRVEAEDVGVYYCMQRIEFPITFGQGTRLEIKR

>67C10_VH
(SEQ ID NO: 1943)
EVQLVQSGAEVKKPGESLKISCQGSGYSFSSYWIGWVRQMPGKGLEWMGIIYPGDS
DTRYSPSFQGQVTISADKSINTA YLQWSSLKASDTAIYYCARRASRGYRYGLAFAIW
GQGTMVTVSS

>67C10_VK.02
(SEQ ID NO: 2082)
DFVMTQTPLSLPVTPGEPASISCRSSQSLLNSDEGNTYLDWYLQKPGQSPQLLIYTLS
YRASGVPDRFSGSGSGTDFTLKISRVEAEDVGVYYCMQRIEFPITFGQGTRLEIKR

>67C10_VH
(SEQ ID NO: 1943)
EVQLVQSGAEVKKPGESLKISCQGSGYSFSSYWIGWVRQMPGKGLEWMGIIYPGDS
DTRYSPSFQGQVTISADKSINTA YLQWSSLKASDTAIYYCARRASRGYRYGLAFAIW
GQGTMVTVSS

>67C10_VK
(SEQ ID NO: 1942)
DFVMTQTPLSLPVTPGEPASISCRSSQSLLNSDDGNTYLDWYLQKPGQSPQLLIYTLS
YRASGVPDRFSGSGSGTDFTLKISRVEAEDVGVYYCMQRIEFPITFGQGTRLEIKR

>67C10_VH.03
(SEQ ID NO: 2083)
EVQLVQSGAEVKKPGESLKISCKGSGYSFSSYWIGWVRQMPGKGLEWMGIIYPGDS
DTRYSPSFQGQVTISADKSINTA YLQWSSLKASDTAIYYCARRASRGYRYGLAFAIW
GQGTMVTVSS

>67C10_VK
(SEQ ID NO: 1942)
DFVMTQTPLSLPVTPGEPASISCRSSQSLLNSDDGNTYLDWYLQKPGQSPQLLIYTLS
YRASGVPDRFSGSGSGTDFTLKISRVEAEDVGVYYCMQRIEFPITFGQGTRLEIKR

>67C10_VH.04
(SEQ ID NO: 2084)
EVQLVQSGAEVKKPGESLKISCQGSGYSFSSYWIGWVRQMPGKGLEWMGIIYPGESD
TRYSPSFQGQVTISADKSINTAYLQWSSLKASDTAIYYCARRASRGYRYGLAFAIWG
QGTMVTVSS

>68C8_VL.01
(SEQ ID NO: 2085)
QSVLTQPPSVSAAPGQKVTISCSGSSSNIGNNYVSWYQQLPGTAPKLLIYDNNKRPSG
IPDRFSGSKSGTSATLAITGLQTGDEADYYCGTWDSSLSAVVFGGGTKLTVLG

>68C8_VH
(SEQ ID NO: 1945)
QVQLQESGPGLVKPSETLSLTCTVSGDSVSSGDNYWSWIRQPPGKGLEWIGFMFYSG
STNYNPSLKSRVTISLHTSKNQFSLRLSSVTAADTAVYYCGRYRSDWDYYYGMDVW
GQGTTVTVSS

>68C8_VL.02
(SEQ ID NO: 2086)
QSVLTQPPSVSAAPGQKVTISCSGSSSNIGNNYVSWYQQLPGTAPKLLIYDNNKRPSG
IPDRFSGSKSGTSATLGITGLQTEDEADYYCGTWDSSLSAVVFGGGTKLTVLG

TABLE 16-continued

Exemplary Substitutions

>68C8_VH
(SEQ ID NO: 1945)
QVQLQESGPGLVKPSETLSLTCTVSGDSVSSGDNYWSWIRQPPGKGLEWIGFMFYSG
STNYNPSLKSRVTISLHTSKNQFSLRLSSVTAADTAVYYCGRYRSDWDYYYGMDVW
GQGTTVTVSS

>68C8_VL.03
(SEQ ID NO: 2087)
QSVLTQPPSVSAAPGQKVTISCSGSSSNIGNNYVSWYQQLPGTAPKLLIYDNNKRPSG
IPDRFSGSKSGTSATLGITGLQTGDEADYYCGTWESSLSAVVFGGGTKLTVLG

>68C8_VH
(SEQ ID NO: 1945)
QVQLQESGPGLVKPSETLSLTCTVSGDSVSSGDNYWSWIRQPPGKGLEWIGFMFYSG
STNYNPSLKSRVTISLHTSKNQFSLRLSSVTAADTA VYYCGRYRSDWDYYYGMDVW
GQGTTVTVSS

>68C8_VL
(SEQ ID NO: 1944)
QSVLTQPPSVSAAPGQKVTISCSGSSSNIGNNYVSWYQQLPGTAPKLLIYDNNKRPSG
IPDRFSGSKSGTSATLGITGLQTGDEADYYCGTWDSSLSAVVFGGGTKLTVLG

>68C8_VH.04
(SEQ ID NO: 2088)
QVQLQESGPGLVKPSETLSLTCTVSGGSVSSGDNYWSWIRQPPGKGLEWIGFMFYSG
STNYNPSLKSRVTISLHTSKNQFSLRLSSVTAADTA VYYCGRYRSDWDYYYGMDVW
GQGTTVTVSS

>68C8_VL
(SEQ ID NO: 1944)
QSVLTQPPSVSAAPGQKVTISCSGSSSNIGNNYVSWYQQLPGTAPKLLIYDNNKRPSG
IPDRFSGSKSGTSATLGITGLQTGDEADYYCGTWDSSLSAVVFGGGTKLTVLG

>68C8_VH.05
(SEQ ID NO: 2089)
QVQLQESGPGLVKPSETLSLTCTVSGDSVSSGDNYWSWIRQPPGKGLEWIGFMFYSG
STNYNPSLKSRVTISLDTSKNQFSLRLSSVTAADTAVYYCGRYRSDWDYYYGMDVW
GQGTTVTVSS

>68C8_VL
(SEQ ID NO: 1944)
QSVLTQPPSVSAAPGQKVTISCSGSSSNIGNNYVSWYQQLPGTAPKLLIYDNNKRPSG
IPDRFSGSKSGTSATLGITGLQTGDEADYYCGTWDSSLSAVVFGGGTKLTVLG

>68C8_VH.06
(SEQ ID NO: 2090)
QVQLQESGPGLVKPSETLSLTCTVSGDSVSSGDNYWSWIRQPPGKGLEWIGFMFYSG
STNYNPSLKSRVTISLHTSKNQFSLRLSSVTAADTAVYYCARYRSDWDYYYGMDVW
GQGTTVTVSS

>68C8_VL
(SEQ ID NO: 1944)
QSVLTQPPSVSAAPGQKVTISCSGSSSNIGNNYVSWYQQLPGTAPKLLIYDNNKRPSG
IPDRFSGSKSGTSATLGITGLQTGDEADYYCGTWDSSLSAVVFGGGTKLTVLG

>68C8_VH.07
(SEQ ID NO: 2091)
QVQLQESGPGLVKPSETLSLTCTVSGDSVSSGDNYWSWIRQPPGKGLEWIGFMFYSG
STNYNPSLKSRVTISLHTSKNQFSLRLSSVTAADTAVYYCGRYRSDWDYYYGMDVW
GQGTLVTVSS

>68C8_VL
(SEQ ID NO: 1944)
QSVLTQPPSVSAAPGQKVTISCSGSSSNIGNNYVSWYQQLPGTAPKLLIYDNNKRPSG
IPDRFSGSKSGTSATLGITGLQTGDEADYYCGTWDSSLSAVVFGGGTKLTVLG

>68C8_VH.08
(SEQ ID NO: 2092)
QVQLQESGPGLVKPSETLSLTCTVSGDSVSSGDNYWSWIRQPPGKGLEWIGFMFYSG
STNYNPSLKSRVTISLHTSKNQFSLRLSSVTAADTAVYYCGRYRSDWDYYYGMDVW
GQGTMVTVSS

>68C8_VL.09
(SEQ ID NO: 2093)
QSVLTQPPSVSAAPGQKVTISCSGSSSNIGNNYVSWYQQLPGTAPKLLIYDNNKRPSG
IPDRFSGSKSGTSATLGITGLQTGDEADYYCGTYDSSLSAVVFGGGTKLTVLG

TABLE 16-continued

Exemplary Substitutions

>68C8_VH
(SEQ ID NO: 1945)
QVQLQESGPGLVKPSETLSLTCTVSGDSVSSGDNYWSWIRQPPGKGLEWIGFMFYSG
STNYNPSLKSRVTISLHTSKNQFSLRLSSVTAADTAVYYCGRYRSDWDYYYGMDVW
GQGTTVTVSS

>68C8_VL
(SEQ ID NO: 1944)
QSVLTQPPSVSAAPGQKVTISCSGSSSNIGNNYVSWYQQLPGTAPKLLIYDNNKRPSG
IPDRFSGSKSGTSATLGITGLQTGDEADYYCGTWDSSLSAVVFGGGTKLTVLG

>68C8_VH.10
(SEQ ID NO: 2094)
QVQLQESGPGLVKPSETLSLTCTVSGDSVSSGDNYWSWIRQPPGKGLEWIGFMFYSG
STNYNPSLKSRVTISLHTSKNQFSLRLSSVTAADTA VYYCGRYRSDYDYYYGMDVW
GQGTTVTVSS

Example 14

Immunogenicity Prediction

Immune responses against proteins are enhanced by antigen processing and presentation in the major histocompatability complex (MHC) class II binding site. This interaction is required for T cell help in maturation of antibodies that recognize the protein. Since the binding sites of MHC class II molecules have been characterized, it is possible to predict whether proteins have specific sequences that can bind to a series of common human alleles. Computer algorithms have been created based on literature references and MHC class II crystal structures to determine whether linear 9 amino acid peptide sequences have the potential to break immune tolerance. We used the TEPITOPE™ program called to determine if point mutations of FGF21 are predicted to increase antigen specific T-cells in a majority of humans. Based on the linear protein sequence, none of the mutations examined are expected enhance immunogenicity. Results are shown in Table 17A and Table 17B below.

TABLE 17A

| Protein | Predicted Immunogenicity |
|---|---|
| Met-FGF21 | Low |
| Met-hFGF21(N106D) | Low |
| Met-FGF21 (N122D) | Low |
| hFc(R4).L15.hFGF21(G170E) | Low |
| hFc(R4).L15.hFGF21(P171A) | Low |
| hFc(R4).L15.hFGF21(S172L) | Low |
| p30.hFc.L15.hFGF21(A45K, G170E) | Low |
| p30.hFc.L15.hFGF21 (L98R, P171G) | Low |

TABLE 17B

| Clone | Predicted immunogenicity | LC Total Agretopes | LC Tolerant Agretopes | LC Non-Tolerant Agretopes | LC Non-Tolerant HLA DRB1 | HC Total Agretopes | HC Tolerant Agretopes | HC Non-tolerant Agretopes | HC Non-tolerant HLA DRB1 |
|---|---|---|---|---|---|---|---|---|---|
| 68C8 | Tier 1 | 3 | 3 | 0 | NA | 12 | 12 | 0 | NA |
| 63A10 | Tier 1 | 1 | 1 | 0 | NA | 12 | 12 | 0 | NA |
| 51A8 | Tier 2 | 3 | 2 | 1 | 0101 0701 | 16 | 16 | 0 | NA |
| 51E5 | Tier 2 | 6 | 6 | 0 | NA | 11 | 10 | 1 | 0401 0701 |
| 64B10 | Tier 2 | 2 | 2 | 0 | NA | 12 | 11 | 1 | 0801 |
| 49H12 | Tier 3 | 7 | 5 | 2 | 0101 0701 0801 1301 1501 | 13 | 13 | 0 | NA |
| 54A1 | Tier 3 | 6 | 4 | 2 | 0301 0801 1501 | 14 | 14 | 0 | NA |
| 52A8 | Tier 3 | 6 | 5 | 1 | 0701 | 13 | 12 | 1 | 1301 |
| 60D7 | Tier 4 | 8 | 7 | 1 | 0301 0401 1101 | 16 | 14 | 2 | 0401 1501 |
| 49C8 | Tier 4 | 7 | 5 | 2 | 0801 1501 | 14 | 13 | 1 | 0401 |
| 67C10 | Tier 4 | 8 | 7 | 1 | 0301 0401 1101 | 14 | 12 | 2 | 0101 701 |

Each reference cited herein is incorporated by reference in its entirety for all that it teaches and for all purposes.

The present disclosure is not to be limited in scope by the specific embodiments described herein, which are intended as illustrations of individual aspects of the disclosure, and functionally equivalent methods and components form aspects of the disclosure. Indeed, various modifications of the disclosure, in addition to those shown and described herein will become apparent to those skilled in the art from the foregoing description and accompanying drawings. Such modifications are intended to fall within the scope of the appended claims.

SEQUENCE LISTING (2094 sequences)

SEQ ID NO: 1 - DNA, 630 bp, Homo sapiens
atggactcggacgagaccgggttcgagcactcaggactgtgggtttctgtgctggctggtcttctgctgggagcctgccaggcacaccccatccctgactccagtcctctcctgcaattcgggggccaagtccggcagcggtacctctacacagatgatgcccagcagacagaagcccacctggagatcagggaggatgggacggtggggggcgctgctgaccagagccccgaaagtctcctgcagctgaaagccttgaagccgggagttattcaaatcttgggagtcaagacatccaggttcctgtgccagcggccagatggggccctgtatggatcgctccactttgaccctgaggcctgcagcttccgggagctgcttcttgaggacggatacaatgtttaccagtccgaagcccacggcctcccgctgcacctgccagggaacaagtccccacaccgggaccctgcaccccgaggaccagctcgcttcctgccactaccaggcctgccccccgcacccccggagccacccggaatcctggccccccagccccccgatgtgggctcctcggaccctctgagcatggtgggaccttcccagggccgaagccccagctacgcttcctga

SEQ ID NO: 2 - protein, 209 aa, Homo sapiens [sequence omitted]

SEQ ID NO: 3 - DNA, 2469 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccgtatgcccgtagctccatattggacatcaccagaaaagatggaaaagaaattgcatgcagtgccggctgccaagacagtgaagttcaaatgcccttccagtgggacaccaaacccaacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctga

SEQ ID NO: 4 - protein, 822 aa, Homo sapiens [sequence omitted]

SEQ ID NO: 5 - protein, 374 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLY

SEQ ID NO: 6 - DNA, 3135 bp, Homo sapiens
atgaagccaggctgtgcggcaggatctccagggaatgaatggattttcttcagcactgatgaaataaccacacgctataggaatacaatgtccaacgggggattgcaaagatctgtcatcctgtcagcacttattctgctacgagctgttactggattctctggagatggaagagctatatggtctaaaaatcctaattttactccggtaaatgaaagtcagctgtttctctatgacactttccctaaaaactttttctggggtattgggactggagcattgcaagtggaagggagttggaagaaggatggaaaaggaccttctatatgggatcatttcatccacacacaccttaaaaatgtcagcagcacgaatggttccagtgacagttatatttttctggaaaaagacttatcagccctggattttataggagtttctttttatcaattttcaatttcctggccaaggcttttccccgatggaatagtaacagttgccaacgcaaaaggtctgcagtactacagtactcttctggacgctctagtgcttagaaacattgaacctatagttactttataccactgggatttgcctttggcactacaagaaaaatatggggggtggaaaaatgataccataatagatatcttcaatgactatgccacatactgtttccagatgtttggggaccgtgtcaaatattggattacaattcacaacccatatctagtggcttggcatgggtatgggacaggtatgcatgcccctggagagaagggaaatttagcagctgtctacactgtgggacacaacttgatcaaggctcactcgaaagtttggcataactacaacacacatttccgcccacatcagaagggttggttatcgatcacgttgggatctcattggatcgagccaaaccggtcggaaaacacgatggatatattcaaatgtcaacaatccatggtttctgtgcttggatggtttgccaaccctatccatggggatggcgactatccagaggggatgagaaagaagttgttctccgttctacccattttctctgaagcagagaagcatgagatgagaggcacagctgatttctttgccttttcttttggacccaacaacttcaagcccctaaacaccatggctaaaatgggacaaaatgtttcacttaatttaagagaagcgctgaactggattaaactggaatacaacaaccctcgaatcttgattgctgagaatggctggttcacagacagtcgtgtgaaaacagaagacaccacggccatctacatgatgaagaatttcctcagccaggtgcttcaagcaataaggttagatgaaatacgagtgtttggttatactgcctggtctctcctggatggctttgaatggcaggatgcttacaccatccgccgaggattattttatgtggattttaacagtaaacagaaagagcggaaacctaagtcttcagcacactactacaaacagatcatacgagaaaatggtttttctttaaaagagtccacgccagatgtgcagggccagtttccctgtgacttctcctggggtgtcactgaatctgttcttaagcccgagtctgtggcttcgtccccacagttcagcgatcctcatctgtacgtgtggaacgccactggcaacagactgttgcaccgagtggaaggggtgaggctgaaaacacgacccgctcaatgcacagattttgtaaacatcaaaaaacaacttgagatgttggcaagaatgaaagtcacccactaccggtttgctctggattgggcctcggtccttcccactggcaacctgtccgcggtgaaccgacaggccctgaggtactacaggtgcgtggtcagtgaggggctgaagcttggcatctccgcgatggtcaccctgtattatccgacccacgcccacctaggcctccccgagcctctgttgcatgccgacgggtggctgaacccatcgacggccgaggccttccaggcctacgctgggctgtgcttccaggagctgggggacctggtgaagctctggatcaccatcaacgagcctaaccggctaagtgacatctacaaccgctctggcaacgacacctacggggcggcgcacaacctgctggtggcccacgccctggcctggcgcctctacgaccggcagttcaggccctcacagcgcggggccgtgtcgctgtcgctgcacgcggactgggcggaacccgccaacccctatgctgactcgcactggagggcggccgagcgcttcctgcagttcgagatcgcctggttcgccgagccgctcttcaagaccggggactaccccgcggccatgagggaatacattgcctccaagcaccgacgggggctttccagctcggccctgccgcgcctcaccgaggccgaaaggaggctgctcaagggcacggtcgacttctgcgcgctcaaccacttcaccactaggttcgtgatgcacgagcagctggccggcagccgctacgactcggacagggacatccagtttctgcaggacatcacccgcctgagctcccccacgcgcctggctgtgattccctggggggtgcgcaagctgctgcggtgggtccggaggaactacggcgacatggacatttacatcaccgccagtggcatcgacgaccaggctctggaggatgaccggctccggaagtactacctagggaagtaccttcaggaggtgctgaaagcatacctgattgataaagtcagaatcaaaggctattatgcattcaaactggctgaagagaaatctaaacccagatttggattcttcacatctgattttaaagctaaatcctcaatacaattttacaacaaagtgatcagcagcaggggcttcccttttgagaacagtagttctagatgcagtcagacccaagaaaatacagagtgcactgtctgcttattccttgtgcagaagaaaccactgatattcctgggttgttgcttcttctccaccctggttctactcttatcaattgccatttttcaaaggcagaagagaagaaagttttggaaagcaaaaaacttacaacacataccattaaagaaaggcaagagagttgttagctaa

SEQ ID NO: 7 - protein, 1044 aa, Homo sapiens
MKPGCAAGSPGNEWIFFSTDEITTRYRNTMSNGGLQRSVILSALILLRAVTGFSGDGRAIWSKNPNFTPVNESQLFLYDTFPKNFFWGIGTGALQVEGSWKKDGKGPSIWDHFIHTHLKNVSSTNGSSDSYIFLEKDLSALDFIGVSFYQFSISWPRLFPDGIVTVANAKGLQYYSTLLDALVLRNIEPIVTLYHWDLPLALQEKYGGWKNDTIIDIFNDYATYCFQMFGDRVKYWITIHNPYLVAWHGYGTGMHAPGEKGNLAAVYTVGHNLIKAHSKVWHNYNTHFRPHQKGWLSITLGSHWIEPNRSENTMDIFKCQQSMVSVLGWFANPIHGDGDYPEGMRKKLFSVLPIFSEAEKHEMRGTADFFAFSFGPNNFKPLNTMAKMGQNVSLNLREALNWIKLEYNNPRILIAENGWFTDSRVKTEDTTAIYMMKNFLSQVLQAIRLDEIRVFGYTAWSLLDGFEWQDAYTIRRGLFYVDFNSKQKERKPKSSAHYYKQIIRENGFSLKESTPDVQGQFPCDFSWGVTESVLKPESVASSPQFSDPHLYVWNATGNRLLHRVEGVRLKTRPAQCTDFVNIKKQLEMLARMKVTHYRFALDWASVLPTGNLSAVNRQALRYYRCVVSEGLKLGISAMVTLYYPTHAHLGLPEPLLHADGWLNPSTAEAFQAYAGLCFQELGDLVKLWITINEPNRLSDIYNRSGNDTYGAAHNLLVAHALAWRLYDRQFRPSQRGAVSLSLHADWAEPANPYADSHWRAAERFLQFEIAWFAEPLFKTGDYPAAMREYIASKHRRGLSSSALPRLTEAERRLLKGTVDFCALNHFTTRFVMHEQLAGSRYDSDRDIQFLQDITRLSSPTRLAVIPWGVRKLLRWVRRNYGDMDIYITASGIDDQALEDDRLRKYYLGKYLQEVLKAYLIDKVRIKGYYAFKLAEEKSKPRFGFFTSDFKAKSSIQFYNKVISSRGFPFENSSSRCSQTQENTECTVCLFLVQKKPLIFLGCCFFSTLVLLLSIAIFQRQKRRKFWKAKNLQHIPLKKGKRVVS

SEQ ID NO: 8 - protein, 996 aa, Homo sapiens
MKPGCAAGSPGNEWIFFSTDEITTRYRNTMSNGGLQRSVILSALILLRAVTGFSGDGRAIWSKNPNFTPVNESQLFLYDTFPKNFFWGIGTGALQVEGSWKKDGKGPSIWDHFIHTHLKNVSSTNGSSDSYIFLEKDLSALDFIGVSFYQFSISWPRLFPDGIVTVANAKGLQYYSTLLDALVLRNIEPIVTLYHWDLPLALQEKYGGWKNDTIIDIFNDYATYCFQMFGDRVKYWITIHNPYLVAWHGYGTGMHAPGEKGNLAAVYTVGHNLIKAHSKVWHNYNTHFRPHQKGWLSITLGSHWIEPNRSENTMDIFKCQQSMVSVLGWFANPIHGDGDYPEGMRKKLFSVLPIFSEAEKHEMRGTADFFAFSFGPNNFKPLNTMAKMGQNVSLNLREALNWIKLEYNNPRILIAENGWFTDSRVKTEDTTAIYMMKNFLSQVLQAIRLDEIRVFGYTAWSLLDGFEWQDAYTIRRGLFYVDFNSKQKERKPKSSAHYYKQIIRENGFSLKESTPDVQGQFPCDFSWGVTESVLKPESVASSPQFSDPHLYVWNATGNRLLHRVEGVRLKTRPAQCTDFVNIKKQLEMLARMKVTHYRFALDWASVLPTGNLSAVNRQALRYYRCVVSEGLKLGISAMVTLYYPTHAHLGLPEPLLHADGWLNPSTAEAFQAYAGLCFQELGDLVKLWITINEPNRLSDIYNRSGNDTYGAAHNLLVAHALAWRLYDRQFRPSQRGAVSLSLHADWAEPANPYADSHWRAAERFLQFEIAWFAEPLFKTGDYPAAMREYIASKHRRGLSSSALPRLTEAERRLLKGTVDFCALNHFTTRFVMHEQLAGSRYDSDRDIQFLQDITRLSSPTRLAVIPWGVRKLLRWVRRNYGDMDIYITASGIDDQALEDDRLRKYYLGKYLQEVLKAYLIDKVRIKGYYAFKLAEEKSKPRFGFFTSDFKAKSSIQFYNKVISSRGFPFENSSSRCSQTQENTECTVCLFLVQKKP

SEQ ID NO: 9 - DNA, 3132 bp, Mus musculus
atgaagacaggctgtgcagcagggtctccggggaatgaatggattttcttcagctctgatgaaagaaacacacgctctaggaaaacaatgtccaacagggcactgcaaagatctgccgtgctgtctgcgtttgttctgctgcgagctgttaccggcttctccggagacgggaaagcaatatgggataaaaaacagtacgtgagtccggtaaacccaagtcagctgttcctctatgacactttccctaaaaacttttcctggggcgttgggaccggagcatttcaagtggaagggagttggaagacagatggaagaggaccctcgatctgggatcggtacgtctactcacacctgagaggtgtcaacggcacagacagatccactgacagttacatctttctggaaaaagacttgttggctctggattttttaggagtttctttttatcagttctcaatctcctggccacggttgtttcccaatggaacagtagcagcagtgaatgcgcaaggtctccggtactaccgtgcacttctggactcgctggtacttaggaatatcgagcccattgttaccttgtaccattgggatttgcctctgacgctccaggaagaatatgggggctggaaaaatgcaactatgatagatctcttcaacgactatgccacatactgcttccagacctttggagaccgtgtcaaatattggattacaattcacaacccttaccttgttgcttggcatgggtttggcacaggtatgcatgcaccaggagagaagggaaatttaacagctgtctacactgtgggacacaacctgatcaaggcacattcgaaagtgtggcataactacgacaaaaacttccgccctcatcagaagggttggctctccatcaccttggggtcccattggatagagccaaacagaacagacaacatggaggacgtgatcaactgccagcactccatgtcctctgtgcttggatggttcgccaaccccatccacggggacggcgactaccctgagttcatgaagacgggcgccatgatccccgagttctctgaggcagagaaggaggaggtgaggggcacggctgatttctttgccttttccttcgggcccaacaacttcaggccctcaaacaccgtggtgaaaatgggacaaaatgtatcactcaacttaaggcaggtgctgaactggattaaactggaatacgatgaccctcaaatcttgatttcggagaacggctggttcacagatagctatataaagacagaggacaccacggccatctacatgatgaagaatttcctaaaccaggttcttcaagcaataaaatttgatgaaatccgcgtgtttggttatacggcctggactctcctggatggctttgagtggcaggatgcctatacgacccgacgagggctgttttatgtggactttaacagtgagcagaaagagaggaaacccaagtcctcggctcattactacaagcagatcatacaagacaacggcttccctttgaaagagtccacgccagacatgaagggtcggttcccctgtgatttctcttggggagtcactgagtctgttcttaagcccgagtttacggtctcctccccgcagtttaccgatcctcacctgtatgtgtggaatgtcactggcaacagattgctctaccgagtggaaggggtaaggctgaaaacaagaccatcccagtgcacagattatgtgagcatcaaaaaacgagttgaaatgttggcaaaaatgaaagtcacccactaccagtttgctctggactggacctctatccttcccactggcaatctgtccaaagttaacagacaagtgttaaggtactataggtgtgtggtgagcgaaggactgaagctgggcgtcttccccatggtgacgttgtaccacccaacccactcccatctcggcctccccctgccacttctgagcagtggggggtggctaaacatgaacacagccaaggccttccaggactacgctgagctgtgcttccgggagttgggggacttggtgaagctctggatcaccatcaatgagcctaacaggctgagtgacatgtacaaccgcacgagtaatgacacctaccgtgcagcccacaacctgatgatcgcccatgcccaggtctggcacctctatgataggcagtataggccggtccagcatggggctgtgtcgctgtccttacattgcgactgggcagaacctgccaacccctttgtggattcacactggaaggcagccgagcgcttcctccagtttgagatcgcctggtttgcagatccgctcttcaagactggcgactatccatcggttatgaaggaatacatcgcctccaagaaccagcgagggctgtctagctcagtcctgccgcgcttcaccgcgaaggagagcaggctggtgaagggtaccgtcgacttctacgcactgaaccacttcactacgaggttcgtgatacacaagcagctgaacaccaaccgctcagttgcagacagggacgtccagttcctgcaggacatcacccgcctaagctcgcccagccgcctggctgtaacaccctggggagtgcgcaagctccttgcgtggatccggaggaactacagagacagggatatctacatcacagccaatggcatcgatgacctggctctagaggatgatcagatccgaaagtactacttggagaagtatgtccaggaggctctgaaagcatatctcattgacaaggtcaaaatcaaaggctactatgcattcaaactgactgaagagaaatctaagcctagatttggatttttcacctctgacttcagagctaagtcctctgtccagttttacagcaagctgatcagcagcagtggcctccccgctgagaacagaagtcctgcgtgtggtcagcctgcggaagacacagactgcaccatttgctcatttctcgtggagaagaaaccactcatcttcttcggttgctgcttcatctccactctggctgtactgctatccatcaccgtttttcatcatcaaaagagaagaaaattccagaaagcaaggaacttacaaaatataccattgaagaaaggccacagcagagttttcagctaa

SEQ ID NO: 10 - protein, 1043 aa, Mus musculus
MKTGCAAGSPGNEWIFFSSDERNTRSRKTMSNRALQRSAVLSAFVLLRAVTGFSGDGKAIWDKKQYVSPVNPSQLFLYDTFPKNFSWGVGTGAFQVEGSWKTDGRGPSIWDRYVYSHLRGVNGTDRSTDSYIFLEKDLLALDFLGVSFYQFSISWPRLFPNGTVAAVNAQGLRYYRALLDSLVLRNIEPIVTLYHWDLPLTLQEEYGGWKNATMIDLFNDYATYCFQTFGDRVKYWITIHNPYLVAWHGFGTGMHAPGEKGNLTAVYTVGHNLIKAHSKVWHNYDKNFRPHQKGWLSITLGSHWIEPNRTDNMEDVINCQHSMSSVLGWFANPIHGDGDYPEFMKTGAMIPEFSEAEKEEVRGTADFFAFSFGPNNFRPSNTVVKMGQNVSLNLRQVLNWIKLEYDDPQILISENGWFTDSYIKTEDTTAIYMMKNFLNQVLQAIKFDEIRVFGYTAWTLLDGFEWQDAYTTRRGLFYVDFNSEQKERKPKSSAHYYKQIIQDNGFPLKESTPDMKGRFPCDFSWGVTESVLKPEFTVSSPQFTDPHLYVWNVTGNRLLYRVEGVRLKTRPSQCTDYVSIKKRVEMLAKMKVTHYQFALDWTSILPTGNLSKVNRQVLRYYRCVVSEGLKLGVFPMVTLYHPTHSHLGLPLPLLSSGGWLNMNTAKAFQDYAELCFRELGDLVKLWITINEPNRLSDMYNRTSNDTYRAAHNLMIAHAQVWHLYDRQYRPVQHGAVSLSLHCDWAEPANPFVDSHWKAAERFLQFEIAWFADPLFKTGDYPSVMKEYIASKNQRGLSSSVLPRFTAKESRLVKGTVDFYALNHFTTRFVIHKQLNTNRSVADRDVQFLQDITRLSSPSRLAVTPWGVRKLLAWIRRNYRDRDIYITANGIDDLALEDDQIRKYYLEKYVQEALKAYLIDKVKIKGYYAFKLTEEKSKPRFGFFTSDFRAKSSVQFYSKLISSSGLPAENRSPACGQPAEDTDCTICSFLVEKKPLIFFGCCFISTLAVLLSITVFHHQKRRKFQKARNLQNIPLKKGHSRVFS

SEQ ID NO: 11 - protein, 326 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 12 - protein, 106 aa, Artificial Sequence
  Description of Artificial Sequence: Synthetic polypeptide
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 13 - protein, 105 aa, Artificial Sequence
  Description of Artificial Sequence: Synthetic polypeptide
QPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 14 - protein, 214 aa, Artificial Sequence
  Description of Artificial Sequence: Synthetic polypeptide
DIQMTQSPSSLSASVGDRVTITCRTSQSISSYLNWYQQKPGKAPNLLIYAASSLQSGVPSRFSGSGSGTDFTLTISGLQPEDFSTYYCQQSYSTSLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15 - protein, 214 aa, Artificial Sequence
  Description of Artificial Sequence: Synthetic polypeptide
DIQMTQSPSSLSASVGDRVTITCRTSQSISNYLNWYQQKPGKAPNLLIYAASSLQSGVPSRFSGSGSGTDFTLTISGLQPEDFSTYYCQQSYSTSLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16 - protein, 214 aa, Artificial Sequence
  Description of Artificial Sequence: Synthetic polypeptide
DIQMTQSPSSLSASVGDRITITCRASQIISRYLNWYQQNPGKAPKLLISAASSLQSGVPSRFSGSGSGPDFTLTISSLQPEDFTTYYCQQSYSSPLTFGGGTKVEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17 - protein, 214 aa, Artificial Sequence
  Description of Artificial Sequence: Synthetic polypeptide
DIQMTQSPSSVSSSVGDRVTITCRASQGISRWLAWYQQKPGKAPKLLIYAASSLKSGVPSRFSGSGSGTDFTLTISSLQPEDFATYYCQQANSFPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 18 - protein, 214 aa, Artificial Sequence
  Description of Artificial Sequence: Synthetic polypeptide
DIQMTQSPSSLSASVGDRVTITCRASQNINNYLNWYRQKPGKAPELLIYTTSSLQSGVPSRFSGSGSGTDFTLTISSLETEDFETYYCQQSYSTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19 - protein, 214 aa, Artificial Sequence
  Description of Artificial Sequence: Synthetic polypeptide
SYVLTQPPSVSVAPGQTARITCGGNNIGSKSVQWYQQKPGQAPVLVVYDDSDRPSGIPERFSGSNSGNTASLTISRVEAGDEADYYCQVWDSSSDHVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 20 - protein, 214 aa, Artificial Sequence
  Description of Artificial Sequence: Synthetic polypeptide
SYVLTQPPSVSVAPGQTARITCGGNNIGSKSVHWYQQKPGQAPVLVVYDDSDRPSGIPERFSGSNSGNTATLTISRVEAGDEADYYCQVWDSSSDHVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 21 - protein, 213 aa, Artificial Sequence
  Description of Artificial Sequence: Synthetic polypeptide
SYELTQPHSVSVATAQMARITCGGNNIGSKAVHWYQQKPGQDPVLVIYCDSNRPSGIPERFSGSNPGNTATLTISRIEAGDEADYYCQVWDSSSDGVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 22 - protein, 213 aa, Artificial Sequence
  Description of Artificial Sequence: Synthetic polypeptide
SYELTQPHSVSVATAQMARITCGGNNIGSKTVHWFQQKPGQDPVLVIYSDSNRPSGIPERFSGSNPGNTATLTISRIEAGDEADYYCQVWDSSCDGVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 23 - protein, 213 aa, Artificial Sequence
  Description of Artificial Sequence: Synthetic polypeptide
SYELTQPHSVSVATAQMARITCGGNNIGSKAVHWYQQKPGQDPVLVIYSDSNRPSGIPERFSGSNPGNTATLTISRIEAGDEADYYCQVWDSSSDGVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 24 - protein, 212 aa, Artificial Sequence
  Description of Artificial Sequence: Synthetic polypeptide
SYELTQPPSVSVSPGQTASITCSGDKLGDKYACWYQQKPGQSPVLVIYQDNERPSGIPERFSGSNSGNTATLTISGTQAMDEADYYCQAWDSTTVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 25 - protein, 220 aa, Artificial Sequence
  Description of Artificial Sequence: Synthetic polypeptide
DVVMTQSPLSLPVTLGQPASISRRSSPSLVYSDGNTYLNCFQQRPGHSPRRLIYKGSNWDSGVPDRFSGSGSGTDFTLKISRVEAEDVGIYYCIQDTHWPTCSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26 - protein, 214 aa, Artificial Sequence
  Description of Artificial Sequence: Synthetic polypeptide
DIQMTQSPSSLSASVGDRVTITCRASQDIRNDLGWYQQKPGKAPKRLIYAASNLQRGVPSRFSGSGSGTEFTLTISTLQPEDFATYSCLQHNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27 - protein, 214 aa, Artificial Sequence
  Description of Artificial Sequence: Synthetic polypeptide
DIQMTQSPSSLSASVGDRVTITCRASQGIRNDLGWYQQKPGKAPKRLIYAASNLQSGVPSRFSGSGSGTKFTLTINSLQPEDFATYYCLQLNGYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 28 - protein, 214 aa, Artificial Sequence
  Description of Artificial Sequence: Synthetic polypeptide
DIQMTQSPSSLSASVGDRVTITCRASQDIRNDLGWYQQKPGKAPKRLIYAASNLQRGVPSRFSGSGSGTEFTLTISTLQPDDFATYSCLQHNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 29 - protein, 210 aa, Artificial Sequence
  Description of Artificial Sequence: Synthetic polypeptide
SYDLTQPPSVSVSPGQTASITCSGDKLGDKYVCWYQQKPGQSPVLVIYQDSKRPSGIPERFSGSNSGNTATLTISGIQAMDEADYYCQAWDSRVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 30 - protein, 212 aa, Artificial Sequence
  Description of Artificial Sequence: Synthetic polypeptide
SYEMTQPLSVSVALGQTARITCGGNNIGSKNVHWYQQKPGQAPVLVIYRDSKRPSGIPERFSGSNSGNTATLTISRAQAGDEADYYCQVWDSSSVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 31 - protein, 212 aa, Artificial Sequence
  Description of Artificial Sequence: Synthetic polypeptide
SYELTQPLSVSVALGQTARIPCGGNDIGSKNVHWYQQKPGQAPVLVIYRDRNRPSGIPERFSGSNSGNTATLTISRAQAGDEADYYCQVWDSNPVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 32 - protein, 212 aa, Artificial Sequence
  Description of Artificial Sequence: Synthetic polypeptide
SYELTQPLSVSVALGQTARITCGGNNIGSKNVHWYQQKPGQAPVLVIYRDRNRPSGIPERFSGSNSGNTATLTISRAQAGDEADYYCQVWDSSTVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 33 - protein, 212 aa, Artificial Sequence
  Description of Artificial Sequence: Synthetic polypeptide
SYELTQPLSVSVALGQTARITCGGNNIGSYNVFWYQQKPGQAPVLVIYRDSKRPSGIPERFSGSNSGNTATLTISRAQAGDEADYHCQVWDSSTVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 34 - protein, 214 aa, Artificial Sequence
  Description of Artificial Sequence: Synthetic polypeptide
EIVLTQSPGTLSLSPGERATLSCRASQSVSSIYLAWYQQKPGQAPRLLIYGASSRATGIPDRFSGSGSGTDFTLTISRLEPEDFAVYYCQQYGSSCSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 35 - protein, 214 aa, Artificial Sequence
  Description of Artificial Sequence: Synthetic polypeptide
EIVLTQSPGTLSLSPGERATLSCRASQSVSNSYLAWYQQKPGQAPRLLIYGAFSRATGIPDRFSGSGSGTDFTLTISRLEPEDFAVYYCQQFGRSFTFGGGTKVEIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 36 - protein, 214 aa, Artificial Sequence
  Description of Artificial Sequence: Synthetic polypeptide
EVVLTQSPGTLSLSPGERATLSCRASQTVRNNYLAWYQQQPGQAPRLLIFGASSRATGIPDRFSGSGSGTDFTLTISRLEPEDFAVYYCQQFGSSLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 37 - protein, 214 aa, Artificial Sequence
  Description of Artificial Sequence: Synthetic polypeptide
EIVLTQSPGTLSLSPGERATLSCRASQSVRNSYLAWYQQQPGQAPRLLIYGAFSRASGIPDRFSGSGSGTDFTLTISRLEPEDFAVYYCQQFGSSLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 38 - protein, 214 aa, Artificial Sequence
  Description of Artificial Sequence: Synthetic polypeptide
EIVLTQSPGTLSLSPGERATLSCRASQTIRNSYLAWYQQQPGQAPRLLIYGAFSRATGIPDRFSGGGSGTDFTLTISRLEPEDFAVYYCQQFGSSLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 39 - protein, 214 aa, Artificial Sequence
  Description of Artificial Sequence: Synthetic polypeptide
EIVLTQSPGTLSLSPGERATLSCRASQSVRNSYLAWYQQQPGQAPRLLIYGAFSRATGIPDRFSGSGSGTDFTLTISRLEPEDFAVYYCQQFGSSLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 40 - protein, 214 aa, Artificial Sequence
  Description of Artificial Sequence: Synthetic polypeptide
EILMTQSPATLSVSPGERATLSCRASQSVNSNLAWYQQKPGQAPRLLIYGTSTRATGVPARFGGSGSGTEFTLTISSLQSEDFAFYYCQQYNTWPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 41 - protein, 214 aa, Artificial Sequence
  Description of Artificial Sequence: Synthetic polypeptide
EILMTQSPATLSVSPGERATLSCRASQSVSSNLAWYQQKPGQSPRLLIYGASTRATGIPARFGGSGSGTDFTLTISSLQSEDFAFYYCQQYNTWPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42 - protein, 216 aa, Artificial Sequence
  Description of Artificial Sequence: Synthetic polypeptide
EIVLTQSPGTLSLSPGERATLSCRASQSVSRNYLAWYQQKPGQAPRLLIYGASSRATGVPDRFSGSGSGTDFTLTISRLEPEDFAVYYCQQYGSSSLCSFGQGTNLDIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 43 - protein, 214 aa, Artificial Sequence
  Description of Artificial Sequence: Synthetic polypeptide
EMVMTQSPATLSVSPGERATLSCRASQSVSSQLAWYQEKPGRAPRLLIYGASNRAIDIPARLSGSGSGTEFTLTISSLQSEDFAVYYCQQYNNWPWTFGQGTKVEFKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 44 - protein, 214 aa, Artificial Sequence
  Description of Artificial Sequence: Synthetic polypeptide
EIVMTQSPATLSVSPGERVTLSCRASQSVSSNLAWYQQKPGQAPRLLIHGSSNRAIGIPARFSGSGSGTEFTLTISSLQSADFAVYNCQQYEIWPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 45 - protein, 216 aa, Artificial Sequence
  Description of Artificial Sequence: Synthetic polypeptide
QSVLTQPPSVSAAPGQKVTISCSGSSSNIGNNYVAWYQQLPGTAPKLLIYDNDKRPSGIPDRFSGSKSGTSATLGITGLQTGDEADYYCGTWDSSLSAVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 46 - protein, 216 aa, Artificial Sequence
  Description of Artificial Sequence: Synthetic polypeptide
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 47 - protein, 220 aa, Artificial Sequence
  Description of Artificial Sequence: Synthetic polypeptide
DIVMTQTPLSLPVTPGEPASISCRSSQSLLNSDDGNTYLDWYLQKPGQSPQLLIYTLSYRASGVPDRFSGTGSGTEFTLKISRVEAEDVGVYYCMQRLEFPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 48 - protein, 220 aa, Artificial Sequence
  Description of Artificial Sequence: Synthetic polypeptide
DFVMTQTPLSLPVTPGEPASISCRSSQSLLNSDDGNTYLDWYLQKPGQSPQLLIYTLSYRASGVPDRFSGSGSGTDFTLKISRVEAEDVGVYYCMQRIEFPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 49 - protein, 212 aa, Artificial Sequence
  Description of Artificial Sequence: Synthetic polypeptide
SYELTQPLSVSVALGQTARITCGGNNIGSKNVHWYQQKPGQAPVVVIYRDSKRPSGIPERFSGSNSGNTATLTISRAQAGDEADYYCQVWDSSPVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 50 - protein, 214 aa, Artificial Sequence
  Description of Artificial Sequence: Synthetic polypeptide
DIQMTQSPSSLSVSVGDRVTITCRASQDIRNDLAWYQQTPGKAPKRLIYASSSLQSGVPSRFSGTGSGTEFTLTISSLQPEDFATYFCLQRNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 51 - protein, 220 aa, Artificial Sequence
  Description of Artificial Sequence: Synthetic polypeptide
DIVMTQTPLSLPVIPGEPASIFCRSSQSLLNSDAGTTYLDWYLQKPGQSPQLLIYTLSFRASGVPDRFSGSGSGTDFTLKITRVEAEDVGVYYCMQRIEFPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 52 - protein, 214 aa, Artificial Sequence
  Description of Artificial Sequence: Synthetic polypeptide
DIQMTQSPSSLSASIGDRVTITCRASQNIRTYLNWYQQKPGKAPKLLIYVASSLESGVPSRFSGTGSGTDFALTISSLQPEDFATYYCQQSDSIPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 53 - protein, 214 aa, Artificial Sequence
  Description of Artificial Sequence: Synthetic polypeptide
DIQMTQSPSSLSASVGDRVTITCRASQRISSYLNWYQQKPGKAPKFLIYAVSSLQSGVPSRFSGSGSGTDFTLTISSLEPEDFATYYCQQSYSATFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 54 - protein, 214 aa, Artificial Sequence
  Description of Artificial Sequence: Synthetic polypeptide
EIVLTQSPDFQSVTPKEKVTITCRASQDIGNSLHWYQQKPDQSPKLLIKFASQSFSGVPSRFSGSGSGTDFALTINSLEAEDAATYYCHQSSDLPLTFGGGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 55 - protein, 214 aa, Artificial Sequence
  Description of Artificial Sequence: Synthetic polypeptide
DIQMTQSPSSLSTSVGDRVTITCRASQNIRSYLNWYQLKPGKAPKVLIYGASNLQSGVPSRFSGSGSGTDFTLTISNLQSEDFAIYYCQQSYNTPCSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 56 - protein, 220 aa, Artificial Sequence
  Description of Artificial Sequence: Synthetic polypeptide
DIVMTQTPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 57 - protein, 214 aa, Artificial Sequence
  Description of Artificial Sequence: Synthetic polypeptide
DIQMTQSPSSLSASVGDRVTFTCQASQDINIYLNWYQQKPGKAPKLLIYDVSNLETGVPSRFSGSGSGTDFTFTISSLQPEDIATYFCQQYDNLPFTFGPGTKVDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 58 - protein, 220 aa, Artificial Sequence
  Description of Artificial Sequence: Synthetic polypeptide
DIVLTQTPLSLPVTPGEPASISCRSSQSLLDSDDGDTYLDWYLQKPGQSPQLLIYTLSYRASGVPDRFSGSGSGTDFTLKISRVEAEDVGVYYCMQHIEFPSTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 59 - protein, 214 aa, Artificial Sequence
  Description of Artificial Sequence: Synthetic polypeptide
DIQMTQSPSSLSASIGDRVTITCQASQGISNYLNWYQQKPGKAPKLLIYDASNLETGVPSRFSGSGSGTDFTFTISSLQPEDIATYYCHQYDDLPLTFGGGTKVEIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 60 - protein, 214 aa, Artificial Sequence
  Description of Artificial Sequence: Synthetic polypeptide
DIQMTQSPSSLSASVGDRVTITCQASQDITKYLNWYQQKPGKAPKLLIYDTFILETGVPSRFSGSGSGTDFTFTISSLQPEDIATYYCQQYDNLPLTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61 - protein, 217 aa, Artificial Sequence
  Description of Artificial Sequence: Synthetic polypeptide
NFILTQPHSVSESPGKTVTISCTRSSGSIASDYVQWYQQRPGSSPTTVIYEDKERSSGVPDRFSGSIDSSSNSASLTISGLKTEDEADYYCQSYDRNNHVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 62 - protein, 214 aa, Artificial Sequence
  Description of Artificial Sequence: Synthetic polypeptide
SYELTQPPSVSVSPGQTARITCSGDALPKKYAYWYQQKSGQAPVLVIYEDSKRPSGIPERFSGSISGTMATLTISGAQVEDEADYYCYSTDSSVNHVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 63 - protein, 212 aa, Artificial Sequence
  Description of Artificial Sequence: Synthetic polypeptide
SYDLTQPPSVSVSPGQTASITCSGDELGDKYACWYQQKPGQSPVLVIYQDTKRPSGIPERFSGSNSGNTATLTISGTQAMDEADYYCQAWDSGTVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 64 - protein, 214 aa, Artificial Sequence
  Description of Artificial Sequence: Synthetic polypeptide
DIQMTQSPSSLSASVGDRVTITCRASQDIRNDLGWYQQKPGKAPNRLIYAASSLQFGVPSRFSGSGSGTEFTLTISSLQPEDFATYYCLQHSSYPLTFGGGTRVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 65 - protein, 215 aa, Artificial Sequence
  Description of Artificial Sequence: Synthetic polypeptide
DIQMTQSPSSVSASVGDRVTITCRASQGISSWLAWYQQKPGKAPKLLIYDASSLQSGVPSRFSGSGSGTDFTLTISSLQPEDFATYYCQQTNSFPPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 66 - protein, 214 aa, Artificial Sequence
  Description of Artificial Sequence: Synthetic polypeptide
DIQMTQSPSFLSASVGDRVTITCRASQTISSYLNWHQQKPGKAPKLLIYAASSLQSGVPSRFSGSGSGTDFSLTISSLQPEDFATYYCQQSYSTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 67 - protein, 214 aa, Artificial Sequence
  Description of Artificial Sequence: Synthetic polypeptide
EVVLTQSPATLSVSPGGRATLSCRASQSVSDILAWYQQKPGQAPRLLIYGASTRATGIPARFSGGGSGTEFTLTISSLQSEDFAVYFCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 68 - protein, 216 aa, Artificial Sequence
  Description of Artificial Sequence: Synthetic polypeptide
QSVLTQPPSVSAAPGQKVTISCSGSSSNIGINYVSWYQQLPGTAPKLLIYDNNKRPSGIPDRFSGSKSGTSATLGITGLQTGDEADYCCGTWDSSLSAVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 69 - protein, 219 aa, Artificial Sequence
  Description of Artificial Sequence: Synthetic polypeptide
DIVMTQSPLSLPVTPGEPASISCRSSQSLLHSNGYNYLDWYLQKPGQSPQLLIYLGSNRASGVPDRFSGRGSGTDFSLKISRVEAEDVGIYYCMQALQTPFTFGPGTNVDIKQTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 70 - protein, 215 aa, Artificial Sequence
  Description of Artificial Sequence: Synthetic polypeptide
ENVLTQSPGTLSLSPGERATLSCRASQSVRSSYLAWYQQRPGQAPRLLIFGASRRATGIPDRFSGSGSGTDFTLTISRLEPEDFAVYYCQQYGSSPRSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 71 - protein, 219 aa, Artificial Sequence
  Description of Artificial Sequence: Synthetic polypeptide
DIVMTQSPLSLPVTPGEPASISCRSSQSLQHSNGYNYLDWYLQKPGQSPQLLIYLDSNRASGVPDRFSGSGSGTDFTLKISRVEAEDIGVYYCMQGLQTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 72 - protein, 214 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHKSYPFTFGPGTKMDIKGTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 73 - protein, 213 aa, Artificial Sequence
  Description of Artificial Sequence: Synthetic polypeptide
EIVMTQSPVTLSVSPGERAIISCRASQSVSSNVAWYQQKPGQTPRLLIYGASTRATGLPTRFSGSGSGTVFTLTISSLQPEDFAVYYCQQFSNSITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 74 - protein, 214 aa, Artificial Sequence
  Description of Artificial Sequence: Synthetic polypeptide
DIQMAQSPSSLSASVGDRVTITCQASQDISIYLNWYQLKPGKAPKLLIYDVSNLETGVPSRFSGGGSGTDFTFTISSLQPEDIATYYCQQYDNLPLTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 75 - protein, 214 aa, Artificial Sequence
  Description of Artificial Sequence: Synthetic polypeptide
EIVVTQSPGTLSLSVGERAILSCRASQSFSSSYLAWYQQKPGQAPRLLIYGASSRATGIPDRFSGSGSGTDFTLTISRLEPEDFAVYYCQQYGSSRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 76 - protein, 214 aa, Artificial Sequence
  Description of Artificial Sequence: Synthetic polypeptide
DIQMTQSPSSLSVSVGDRVTITCRASQDISNYLAWFQQKPGKAPKSLIYAASSLQSGVPSKFSGSGSGTDFTLTISSLQPEDFATYYCQQYNIYPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 77 - protein, 214 aa, Artificial Sequence
  Description of Artificial Sequence: Synthetic polypeptide
DIQMTQSPSSLSTSIGDRITITCRASQSISNYLNWFQQIPGKAPRLLIYTASSLQSGVPSRFSGSGSGTDFTLTISSLQPEDFATYYCQQSSSIPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 78 - protein, 219 aa, Artificial Sequence
  Description of Artificial Sequence: Synthetic polypeptide
DIVMTQSPLSLPVTPGEPASISCRSSQSLLHSNGFNYLDWYLQKPGQSPQVLIYLGSNRASGVPDRFSGSGSGTDFTLKISRVEAEDVGIYYCMQALQTLITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 79 - protein, 212 aa, Artificial Sequence
  Description of Artificial Sequence: Synthetic polypeptide
SYELTQPPSVSVSPGQTASITCSGDNLGDKYAFWYQQKPGQSPVLVIYQDNKRPSGIPERFSGSNSGNTATLTISGTQAVDEADYYCQAWDSATVIFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 80 - protein, 215 aa, Artificial Sequence
  Description of Artificial Sequence: Synthetic polypeptide
DIQMTQSPSSVSASVGDRVTITCRASQDISSWLAWYQQKPGKAPKFLIYDASTLQSGVPSRFSGSGSGADFTLTINNLQPEDFATYYCQQTNSFPPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 81 - protein, 213 aa, Artificial Sequence
  Description of Artificial Sequence: Synthetic polypeptide
SYVLTQPPSVSVAPGQAARITCGGNDIGSKSVHWYQQKPGQAPVLVVYDDSDRPSGIPERFSGSKSGNTATLIISRVEAGEEADYYCQVWDSSSDVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 82 - protein, 214 aa, Artificial Sequence
  Description of Artificial Sequence: Synthetic polypeptide
DLQMTQSPSSLSASVGDRVTITCQASQDIKKFLNWYQQKPGKAPNLLIYDASNLETGVPSRFSGSGSGTDFTFTISSLQPEDIATYYCQQYAILPFTFGPGTTVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 83 - protein, 214 aa, Artificial Sequence
  Description of Artificial Sequence: Synthetic polypeptide
DIQMTQSPSSLSASVGDRVTITCRASQSISNYLNWFLQIPGKAPKLLIYAASSLQSGVPSRFSGSGSGTDFTLTINSLQPEDFGTYYCQQSSTIPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 84 - protein, 215 aa, Artificial Sequence
  Description of Artificial Sequence: Synthetic polypeptide
EIVLTQSPGTLSLSPGERATLSCRASQSVSRDYLAWYRQKPGQAPRLLVYGASARATGIPDRFSGSGSGTDFTLTISRLEPEDFAVYYCQQYGRSLFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 85 - protein, 214 aa, Artificial Sequence
  Description of Artificial Sequence: Synthetic polypeptide
DIQMTQSPSSLSVSVGDRVTITCRASHDISNYLAWFQQKPGKAPKSLIYAASSLQSGVPSKFSGSGSGTDFTLTISSLQPEDFATYYCQQYNTYPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 86 - protein, 215 aa, Artificial Sequence
  Description of Artificial Sequence: Synthetic polypeptide
EIVLTQSPGTLSLSPGERATLSCRASPSVSSSYLAWYQQKPAQAPRLLIYGASSRATGIPDRFSGSGSGTDFTLTISRLEPEDFAVYYCHQYGTSPCSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 87 - protein, 215 aa, Artificial Sequence
  Description of Artificial Sequence: Synthetic polypeptide
DIQMTQSPSSVSASVGDRVTITCRASQGISSWLAWYQQKPGKAPKLLIYGASSLQSGVPSRFSGSGSGTDFTLTISSLQPEDFATYYCQQTNSFPPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 88 - protein, 215 aa, Artificial Sequence
  Description of Artificial Sequence: Synthetic polypeptide
DIQMTQSPSSVSASVGDRVTITCRASQDIDSWLVWYQQKPGKAPNLLIYAASNLQRGVPSRFSGSGSGTDFTLTIASLQPEDFATYYCQQTNSFPPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 89 - protein, 213 aa, Artificial Sequence
  Description of Artificial Sequence: Synthetic polypeptide
SYELSQPPSVSVSPGQTVSITCSGDNLGDKYACWYQQRPGQSPVLVIYQDTKRPSGIPERFSGSNSGNTATLTISGTQAMDEADYYCQAWDSSTTWVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 90 - protein, 216 aa, Artificial Sequence
  Description of Artificial Sequence: Synthetic polypeptide
QSVLTQPPSVSAAPGQKVTISCSGSSSNIGDNYVSWYQQFPGTAPKLLIYDNNKRPSGIPDRFSGSKSGTSATLGITGLQTGDEADYYCGTWDSSLSVMVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 91 - protein, 220 aa, Artificial Sequence
  Description of Artificial Sequence: Synthetic polypeptide
DIVLTQTPLSLPVTPGEPASISCRSSQSLLDSDDGDTYLDWYLQKPGQSPQLLIYTLSYRASGVPDRFSGSGSGTDFTLKISRVEAEDVGVYYCMQRIEFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 92 - protein, 216 aa, Artificial Sequence
  Description of Artificial Sequence: Synthetic polypeptide
EIMLTQSPGTLSLSPGERATLSCRASQRVPSSYIVWYQQKPGQAPRLLIYGSSNRATGIPDRFSGSGSGTDFTLTIGRLEPEDFAVYYCQQYGSSPPWTFGQGTKVAIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 93 - protein, 212 aa, Artificial Sequence
  Description of Artificial Sequence: Synthetic polypeptide
SYELTQPPSVSVSPGQTASITCSGNKLGDKYVCWYQQKPGQSPVLVIYQDSKRPSGIPERFSGSNSGNTATLTISGTQALDEADYYCQAWDSSTWVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 94 - protein, 216 aa, Artificial Sequence
  Description of Artificial Sequence: Synthetic polypeptide
EIMLTQSPGTLSLSPGERATLSCRASQRVPSSYLVWYQQKPGQAPRLLIYGASNRATGIPDRFSGSGSGTDFTLTIGRLEPEDFAVYYCQQYGSSPPWTFGQGTKVAIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 95 - protein, 214 aa, Artificial Sequence
  Description of Artificial Sequence: Synthetic polypeptide
DIQMTQSPSSLSASIGDRVTITCRASQSISNYLNWFQQIPGKAPRLLIYAASSLQSGVPSRFSGSGSGTDFTLTISSLQPEDFAIYYCQQSSSIPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 96 - protein, 215 aa, Artificial Sequence
  Description of Artificial Sequence: Synthetic polypeptide
EIVLTQSPGTLSLSPGERATLSCRASQSVSRDYLAWYRQKPGQAPRLLIYGASSRATGIPDRFSGSGSGTDFTLTISRLEPEDFAVYYCQQYGRSLFTFGPGTTVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 97 - protein, 214 aa, Artificial Sequence
  Description of Artificial Sequence: Synthetic polypeptide
SYELTQPPSVSVSPGQTARITCSGDAVPKKYANWYQQKSGQAPVLVIYEDSKRPSGIPERFSGSSSGTMATLTISGAQVEDEADYYCYSTDSSGNHVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 98 - protein, 212 aa, Artificial Sequence
  Description of Artificial Sequence: Synthetic polypeptide
SYELTQPPSVSVSPGQTASITCSGDKLGDKYVCWYQQMPGQSPVLVIHQNNKRPSGIPERFSGSNSGNTATLTISGTQAMDEADYYCQAWDSSTAVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 99 - protein, 214 aa, Artificial Sequence
  Description of Artificial Sequence: Synthetic polypeptide
ETVMTQSPATLSVSPGERATLSCRARQSVGSNLIWYQQKPGQAPRLLIFGASSRDTGIPARFSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 100 - protein, 212 aa, Artificial Sequence
  Description of Artificial Sequence: Synthetic polypeptide
SYELTQPLSVSVALGQTARLTCGGNNIGSINVHWYQQKPGQAPVLVIYRDRNRPSGIPERFSGSNSGNTATLTISRAQAGDEADYYCQLWDSSTVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 101 - protein, 215 aa, Artificial Sequence
  Description of Artificial Sequence: Synthetic polypeptide
EIVLTQSPGTLSLSPGERATLSCRASQSVASSYLVWYQQKPGQAPRLLIYGAFSRATGIPDRFSGSGSGTDFTLTIRRLEPEDFAVYYCQQYGTSPFTFGPGTKVDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 102 - protein, 220 aa, Artificial Sequence
  Description of Artificial Sequence: Synthetic polypeptide
DIVMTQTPLSLPVSPGEPASISCRSSQSLLDSDDGDTYLDWYLQKPGQSPQLLIYTLSYRASGVPDRFSVSGSGTDFTLKISRVEAEDVGVYYCMQRIEFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 103 - protein, 220 aa, Artificial Sequence
  Description of Artificial Sequence: Synthetic polypeptide
EIVMTQTPLSLPVTPGEPASISCRSSQSLFDNDDGDTYLDWYLQKPGQSPQLLIYTLSYRASGVPDRFSGSGSGTDFTLKISRVEAEDVGVYYCMQRLEFPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 104 - protein, 214 aa, Artificial Sequence
  Description of Artificial Sequence: Synthetic polypeptide
DIQMTQSPSSLSASVGDRVTITCRASQDISNYLAWYQQKPGKVPTLLIYAASTLLSGVPSRFSGSGSGTDFTLTISSLQPEDVAAYYCQKYYSAPFTFGPGTKVDINRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 105 - protein, 214 aa, Artificial Sequence
  Description of Artificial Sequence: Synthetic polypeptide
DIQMTQSPSSLSASVGDRVTITCRASQGIRNDLGWYQQKPGKAPNRLIYAASSLQSGVPSRFSGSGSGTEFTLTISSLQPEDFATYYCLQHNSYPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 106 - protein, 219 aa, Artificial Sequence
  Description of Artificial Sequence: Synthetic polypeptide
DVVMTQCPLSLPVTLGQPASISCRSSQRLVYSDGNTYLNWVQQRPGQSPRRLIYKVSNWDSGVPDRFSGSGSGTDFTLKISRVEAEDVGVNYCMEGTHWPRDFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 107 - protein, 214 aa, Artificial Sequence
  Description of Artificial Sequence: Synthetic polypeptide
DIQMTQSPSSLSASIGDRVTITCRASQSISNYLNWFQQIPGKAPRLLIYAASSLQSGVPSRFSGSGSGTDFTLTISSLQPEDFATYYCQQSSSIPWTFGQGTTVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 108 - protein, 214 aa, Artificial Sequence
  Description of Artificial Sequence: Synthetic polypeptide
DIVMTQSPATLSVSPGERATLSCRASQSISSNLAWYQQTPGQAPRLLIYGTSIRASTIPARFSGSGSGTEFTLTISSLQSEDFAIYYCHQYTNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 109 - protein, 214 aa, Artificial Sequence
  Description of Artificial Sequence: Synthetic polypeptide
DIQMTQSPSSLSASVGDRVTITCRASQTISIYLNWYQQKPGKAPKFLIYSASSLQSGVPSRFSGSGSGTDFTLTISSLQPEDFSTYFCQQSYSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 110 - protein, 214 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQTYSAPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 111 - protein, 215 aa, Artificial Sequence
  Description of Artificial Sequence: Synthetic polypeptide
EIVLTQSPGTLSLSPGERATLSCRASQSVSRSHLAWYQQNSGQAPRLLIYGASSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 112 - protein, 214 aa, Artificial Sequence
  Description of Artificial Sequence: Synthetic polypeptide
DIQMTQSPSSLSASIRDRVTITCRASQSIGTFLNWYQQKPGTAPKLLIYAASSLQSGVPSRFSGSGSGTDFTLTISSLHPEDFASYYCQQSFSTPLTFGGGTKVEITRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 113 - protein, 445 aa, Artificial Sequence
  Description of Artificial Sequence: Synthetic polypeptide
QVQLMQSGAEVKKPGASVKVSCKASGYTFTGYYMHWVRQAPGQGLEWMGWMNPNSGATKYAQKFQGRVTMTRDTSISTAYMELSRLRSDDTAVYYCARELGDYPFFDYWGQGTLGIVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 114 - protein, 445 aa, Artificial Sequence
  Description of Artificial Sequence: Synthetic polypeptide
QVQLVQSGAEVKKPGASVKVSCRASGYTFTGYYIHWMRQAPGHGLEWMGWINPPSGATNYAQKFRGRVAVTRDTSISTVYMELSRLRSDDTAVYYCARETGTWNFFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 115 - protein, 446 aa, Artificial Sequence
  Description of Artificial Sequence: Synthetic polypeptide
QVQLVQSGAEVKKPGASVKVSCKASGYTFTGYYLHWVRQAPGQGLEWMGWINPNSGGTDYAQKFQGRVTMTRDTSISTAYMELSRLRSDDTAVYYCVGDAATGRYYFDNWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 116 - protein, 445 aa, Artificial Sequence
  Description of Artificial Sequence: Synthetic polypeptide
QVQLVQSGAEVKRPGASVKVSCKASGYTFTGYFMHWVRQAPGQGLEWMGWINPNSGATNYAQKFHGRVTMTRDTSITTVYMELSRLRSDDTAVYYCTRELGIFNWFDPWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 117 - protein, 449 aa, Artificial Sequence
  Description of Artificial Sequence: Synthetic polypeptide
EVQLVESGGGLVQPGGSLRLSCAASGFAFSSYDMHWVRQATGKGLEWVSTIDTAGDAYYPGSVKGRFTISRENAKTSLYLQMNSLRAGDTAVYYCTRDRSSGRFGDFYGMDVWGQGTAVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 118 - protein, 449 aa, Artificial Sequence
  Description of Artificial Sequence: Synthetic polypeptide
EVQLEESGGGLVQPGGSLRLSCAASGFTFRTYDMHWVRQVTGKGLEWVSAIGIAGDTYYSDSVKGRFTISRENAKNSLYLQMNSLRVGDTAVYYCARDRSSGRFGDYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 119 - protein, 451 aa, Artificial Sequence
  Description of Artificial Sequence: Synthetic polypeptide
EVQLVESGGDLVKPGGSLRLSCAVSGITFSNAWMSWVRQAPGKGLEWVGRIKSKTDGGTTDYAAPVKGRFTVSRDGSKNTLYLQMNSLKTEDTAVYYCTTDSSGSYYVEDYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 120 - protein, 451 aa, Artificial Sequence
  Description of Artificial Sequence: Synthetic polypeptide
EVQLVESGGGLVKPGGSLRLSCAASGFTFSNAWMSWVRQAPGKGLEWVGRIIGKTDGGTTDYAAPVKGRFTISRDDSKNTLYLQMNSLKTEDTAVYYCTSDSSGSYYVEDYFDYWGQGTLVAVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 121 - protein, 451 aa, Artificial Sequence
  Description of Artificial Sequence: Synthetic polypeptide
EVQLVESGGGLVKPGGSLRLACAASGITFNNAWMSWVRQAPGKGLEWVGRIKSKTDGGTTDYAAPVKGRFTISRDDSKSILYLQMNSLKSEDTAVYYCTTDSSGSYYVEDYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 122 - protein, 451 aa, Artificial Sequence
  Description of Artificial Sequence: Synthetic polypeptide
QVQLVESGGGVVQPGRSLRLSCVASGFTFSSYGMHWVRQDPGKGLEWVAVISYDGSNKHYADSVKGRFTISRDNSKNTLYLQMNSLRAEDTAVYYCARELLWFGEYGVDHGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 123 - protein, 449 aa, Artificial Sequence
  Description of Artificial Sequence: Synthetic polypeptide
QAQLVESGGGVVQPGRSLRLSCAASGFTFSSYGIHWVRQAPGKGLEWVAVISYDGSNKYYADSVKGRFTISRDNSKNTLYLQMNSLRAEDTAVYYCATTVTKEDYYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 124 - protein, 449 aa, Artificial Sequence
  Description of Artificial Sequence: Synthetic polypeptide
QVQLVESGGGVVQPGRSLRLSCAASGFTFSSYGMHWVRQAPGKGLEWVAGISYDGSNKNYADSVKGRITISRDNPKNTLYLQMNSLRAEDTAVYYCATTVTKEDYYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 125 - protein, 445 aa, Artificial Sequence
  Description of Artificial Sequence: Synthetic polypeptide
QVQLVESGGGVVQPGRSLRLSCAASGFTFSYYYIHWVRQAPGKGLEWVALIWYDGSNKDYADSVKGRFTISRDNSKNTLYLHVNSLRAEDTAVYYCAREGTTRRGFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 126 - protein, 445 aa, Artificial Sequence
  Description of Artificial Sequence: Synthetic polypeptide
QVQLVESGGGVVQPGRSLRLSCAASGFTFSSYGMHWVRQAPGKGLEWVAVIWDDGSNKYYADSVKGRFTISRDNSKNTLSLQMNSLRAEDTAVYYCAREYVAEAGFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 127 - protein, 444 aa, Artificial Sequence
  Description of Artificial Sequence: Synthetic polypeptide
QEQLVESGGGVVQPGRSLRLSCAVSGFTFSFYGMHWVRQAPGKGLEWVAVIWYDGSNKYYADSVKGRFTISRDNSKNTLYLQMNSLRAEDTAVYYCTRALNWNFFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 128 - protein, 444 aa, Artificial Sequence
  Description of Artificial Sequence: Synthetic polypeptide
QVQLVESGGGVVQPGRSLRLSCAASGFTLSNYNMHWVRQAPGKGLEWVAVLWYDGNTKYYADSVKGRVTISRDNSKNTLYLQMNSLRAEDTAVYYCARDVYGDYFAYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 129 - protein, 445 aa, Artificial Sequence; identical to SEQ ID NO: 126
  Description of Artificial Sequence: Synthetic polypeptide

SEQ ID NO: 130 - protein, 446 aa, Artificial Sequence
  Description of Artificial Sequence: Synthetic polypeptide
QVQLVESGGGVVQPGRSLRLSCTASGFTFSSYGMHWVRQAPGKGLEWVAVIWYDGSNKYHADSVKGRFTISRDDSKNALYLQMNSLRAEDTAVYYCVRDPGYSYGHFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 131 - protein, 446 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKDYADSVKGRFTISRDNSKNTLYLQMNSLRAEDTAVYYCARSAVALYNWFDPWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 132 - protein, 449 aa, Artificial Sequence
  Description of Artificial Sequence: Synthetic polypeptide
QVQLQESGPGLVNPSQTLSLTCTVSGGSISSDAYYWSWIRQHPGKGLEWIGYIFYSGSTYYNPSLKSRVTISVDTSKNRFSLKLSSVTAADTAVYYCARESRILYFNGYFQHWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 133 - protein, 446 aa, Artificial Sequence
  Description of Artificial Sequence: Synthetic polypeptide
QVQLQESGPGLVKPSQTLSLTCAVSGGSISSGDYYWSWIRQHPGKGLEWIGYIYYSGTTYYNPSLKSRVTISVDTSKNQFSLKLTSVTAADTAVYYCARMTTPYWYFGLWGRGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 134 - protein, 446 aa, Artificial Sequence
  Description of Artificial Sequence: Synthetic polypeptide
QVQLQESGPGLVKPSQTLSLTCPVSGGSISSGDYYWTWIRQHPGKDLEWITYIYYSGSAYYNPSLKSRVTISVDTSKNQFSLKLSSVTAADTAVYYCARMTTPYWYFDLWGRGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 135 - protein, 446 aa, Artificial Sequence
  Description of Artificial Sequence: Synthetic polypeptide
QVQLQESGPGLVKPSQTLSLTCPVSGGSISSGDYYWTWIRQHPGKGLEWIAYIYYSGSTYYNPSLKSRVTISVDTSKNQFSLKLSSVTAADTAVYYCARMTTPYWYFDLWGRGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 136 - protein, 446 aa, Artificial Sequence
  Description of Artificial Sequence: Synthetic polypeptide
QVQLQESGPGLVKPSQTLSLTCPVSGGSISSGDYYWTWIRQHPGKGLEWIAYIYYTGSTYYNPSLKSRVTISVDTSKNQFSLKLSSVTAADTAVYYCARMTTPYWYFDLWGRGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 137 - protein, 446 aa, Artificial Sequence
  Description of Artificial Sequence: Synthetic polypeptide
QVQLQESGPGLVKPSQTLSLTCPVSGGSISSGDYYWTWIRQHPGKGLEWIAYIFYSGSTYYNPSLKSRVTISLDTSKNQFSLKLNSVTAADTAVYYCARMTSPYWYFDLWGRGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 138 - protein, 446 aa, Artificial Sequence
  Description of Artificial Sequence: Synthetic polypeptide
QVQLQESGPGLVKPSQTLSLTCPVSGGSISSGDYYWTWIRHHPGKGLEWIAYIYYSGSTYYNPSLKSRVTISVDTSKNQFSLKLNSVTAADTAVYYCARMTTPYWYFDLWGRGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 139 - protein, 452 aa, Artificial Sequence
  Description of Artificial Sequence: Synthetic polypeptide
QVQLQESGPGLVKPSQTLSLTCTVSGGSISSGGYYWSWIRQRPGKGLEWVGYIYYSGGTHYNPSLKSRVTISIDTSENQFSLKLSSVTAADTAVYYCARVLHYSDSRGYSYYSDFWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 140 - protein, 452 aa, Artificial Sequence
  Description of Artificial Sequence: Synthetic polypeptide
QVQLQESGPGLVKPSQTLSLTCTLSGGSFSSGDYYWSWIRQHPGKGLEWIGYIYYSGSTYYNPSLKSRVTISIDTSKNQFSLKLTSVTAADTAVYYCARVLHYYDSSGYSYYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 141 - protein, 446 aa, Artificial Sequence
  Description of Artificial Sequence: Synthetic polypeptide
QLQLQESGPGLVKPSETLSLTCTVSGGSISSDTSYWGWIRQPPGKGLEWIGNIYYSGTTYFNPSLKSRVSVSVDTSKNQFSLKLSSVTAADTAVFYCARLRGVYWYFDLWGRGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 142 - protein, 445 aa, Artificial Sequence
  Description of Artificial Sequence: Synthetic polypeptide
QVQLQESGPGLVKPSETLSLTCTVSGGSISSYYWSWIRQPPGKGLEWIGYIYYTGSTNYNPSLKSRVTISVDTSKNQFSLKLSSVTAADTAVYYCAREYYYGSGSYYPWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 143 - protein, 445 aa, Artificial Sequence
  Description of Artificial Sequence: Synthetic polypeptide
QVQLKESGPGLVKPSETLSLTCTVSGGSISSYYWSWIRQPPGKGLEWIGYIYYSGNTNYNPSLKSRVTISVDTSKNQFSLKLSSVTAADTAVYYCAREYYYGSGSYYPWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 144 - protein, 449 aa, Artificial Sequence
  Description of Artificial Sequence: Synthetic polypeptide
QIQLLESGPGLVKPSETLSLTCTVSGGSVSSGDYYWSWIRQPPGKGLEWIGFIYYSGGTNYNPSLKSRVTISIDTSKNQFSLKLNSVTAADTAVYYCARYSSTWDYYYGVDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 145 - protein, 449 aa, Artificial Sequence
  Description of Artificial Sequence: Synthetic polypeptide
QVQLQESGPGLVKPSETLSLTCTVSGDSVSSGDNYWSWIRQPPGKGLEWIGFMFYSGSTNYNPSLKSRVTISLHTSKNQFSLRLSSVTAADTAVYYCGRYRSDWDYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 146 - protein, 449 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSDTRYSPSFQGQVTISADKSINTAYLQWSSLKASDTAIYFCARRASRGYRFGLAFAIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 147 - protein, 449 aa, Artificial Sequence
  Description of Artificial Sequence: Synthetic polypeptide
EVQLVQSGAEVKKPGESLKISCQGSGYSFSSYWIGWVRQMPGKGLEWMGIIYPGDSDTRYSPSFQGQVTISADKSINTAYLQWSSLKASDTAIYYCARRASRGYRYGLAFAIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 148 - protein, 446 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSETRYSPSFQGQVTISADKSISTAYLQWNSLKTSDTAMYFCATVAVSAFNWFDPWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 149 - protein, 454 aa, Artificial Sequence
  Description of Artificial Sequence: Synthetic polypeptide
QVQLKESGPGLVKPSQTLSLTCTVSGGSISSGGYYWNWIRQHPGKGLEWIGYIYDSGSTYYNPSLKSRVTMSVDTSKNQFSLKLSSVTAADTAVYYCARDVLMVYTKGGYYYYGVDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 150 - protein, 449 aa, Artificial Sequence
  Description of Artificial Sequence: Synthetic polypeptide
EVQLVQSGAEVKKPGESLKISCKGSGYSFTGYWIGWVRQLPGKGLEWMGIIYPGDSDTRYSPSFQGQVTISVDKSINTAYLQWSSLKASDTAMYYCARRASRGYSYGHAFDFWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 151 - protein, 443 aa, Artificial Sequence
  Description of Artificial Sequence: Synthetic polypeptide
QVQLQQWGAGLLKPSETLSLTCSVYGGSFSGYYWTWIRQPPGKGLEWIGEINHSENTNYNPSLKSRVTISIDTSKNQFSLKLSSVTAADTAVYYCARESGNFPFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 152 - protein, 447 aa, Artificial Sequence
  Description of Artificial Sequence: Synthetic polypeptide
QVQLQQWGAGPLKPSETLSLTCAVYGGSISGYYWSWIRQPPGKGLEWIGEITHTGSSNYNPSLKSRVTISVDTSKNQFSLKLSSVTAADTAVYYCARGGILWFGEQAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 153 - protein, 446 aa, Artificial Sequence
  Description of Artificial Sequence: Synthetic polypeptide
EVQLVESGGGLVKPGGSLRLSCTASGFTFRSYSMNWVRQAPGKGLEWVSSISSSSSYEYYVDSVKGRFTISRDIAKSSLWLQMNSLRAEDTAVYYCARSLSIAVAASDYWGKGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 154 - protein, 451 aa, Artificial Sequence
  Description of Artificial Sequence: Synthetic polypeptide
QVQLVQSGAEVKKPGASVKVSCKASGYTFTGYYKHWVRQAPGQGLEWMGWINPNSGATKYAQKFQGRVTMTRDTSISTVYMELSRLRSVDTALYYCAREVPDGIVVAGSNAFDFWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 155 - protein, 455 aa, Artificial Sequence
  Description of Artificial Sequence: Synthetic polypeptide
QVHLVESGGGVVQPGRSLRLSCAASGFTFSNYGMHWVRQAPGKGLEWVAIIWYDGSNKNYADSVKGRFTISRDNSKNTLYLEMNSLRAEDTAVYYCARDQDYDFWSGYPYFYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 156 - protein, 446 aa, Artificial Sequence
  Description of Artificial Sequence: Synthetic polypeptide
QVQLVQSGAEVKKPGASVKVSCKASGYTFTSYDIDWVRQATGQGLEWMGWMNPNGGNTGYAQKFQGRVTMTRNTSINTAYMELSSLRSEDTAIYYCARGKEFSRAEFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 157 - protein, 455 aa, Artificial Sequence
  Description of Artificial Sequence: Synthetic polypeptide
QVQLVESGGGVVQPGRSLRLSCAASGFTFSNYGMRWVRQAPGKGLEWVALIWYDGSNKFYADSVKGRFTISRDNSKNTLNLQMNSLRAEDTAVYYCARDRYYDFWSGYPYFFYYGLDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 158 - protein, 449 aa, Artificial Sequence
  Description of Artificial Sequence: Synthetic polypeptide
QVTLKESGPVLVKPTETLTLTCTVSGFSLSNPRMGVSWIRQPPGKALEWLTHIFSNDEKSYSTSLKSRLTISKDTSKSQVVLSMTNMDPVDTATYYCVRVDTLNYHYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 159 - protein, 445 aa, Artificial Sequence
  Description of Artificial Sequence: Synthetic polypeptide
QVQLVQSGAEVKKPGASVKVSCMASGYIFTSYDINWVRQATGQGPEWMGWMNPYSGSTGYAQNFQGRVTMTRNTSINTAYMELSSLRSEDTAVYYCAKYNWNYGAFDFWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 160 - protein, 451 aa, Artificial Sequence
  Description of Artificial Sequence: Synthetic polypeptide
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARADGDYPYYYYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 161 - protein, 444 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYNGSPYDNPSLKRRVTISIDASKNQFSLKLSSMTAADTAVYYCARGALYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 162 - protein, 442 aa, Artificial Sequence
  Description of Artificial Sequence: Synthetic polypeptide
QVQLQQWGAGLLKPSETLSLTCAVYGGSFSGYYWSWIRQPPGKGLEWIGELDHSGSINYNPSLKSRVTISVDTSKNQFSLKLTSVTAADTAVYYCARVLGSTLDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 163 - protein, 448 aa, Artificial Sequence
  Description of Artificial Sequence: Synthetic polypeptide
EVQLVESGGGLVKPGGSLRLSCAASGFTFSSYSMNWVRQAPGKGLEWVSSISSSSTYIYYADSVKGRFTISRDNAKNSLYLQMNSLRAEDTAVYYCARDTYISGWNYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 164 - protein, 445 aa, Artificial Sequence
  Description of Artificial Sequence: Synthetic polypeptide
QVQLVQSGAEVKKPGASVKVSCKASGYTFTGYYLHWVRQAPGQGLEWMGWINPNSAATNYAPKFQGRVTVTRDTSISTAYMELSRLRSDDTAVYYCAREGGTYNWFDPWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 165 - protein, 441 aa, Artificial Sequence
  Description of Artificial Sequence: Synthetic polypeptide
QVQLQESGPGLMKPSETLSLTCTVSGGSISYYYWSWIRQSPGKGLEWIGYIYYSGSTNYNPSLKSRVTMSVDTSKNQFSLKLSSVTAADTAVYYCASGTRAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 166 - protein, 446 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNNYYADSVKGRFTISRDNSKSTLFLQMNSLRAEDTAIYYCARDRAGASPGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 167 - protein, 448 aa, Artificial Sequence
  Description of Artificial Sequence: Synthetic polypeptide
QVQLVQSGAEVKKPGASVKVSCKASGFTFIGYYTHWVRQAPGQGLEWMGWINPSSGDTKYAQKFQGRVTLARDTSISTAYMELSRLRSDDTAVYYCANSGWYPSYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 168 - protein, 447 aa, Artificial Sequence
  Description of Artificial Sequence: Synthetic polypeptide
QVQLQESGPGLVKPSETLSLTCTVSGGSISTYYWSWIRQPPGTGLEWIGYIFYNGNANYSPSLKSRVTFSVDTSKNQFSLKLSSVTAADTAVYFCARETDYGDYARPFEYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 169 - protein, 446 aa, Artificial Sequence
  Description of Artificial Sequence: Synthetic polypeptide
QVQLVESGGGVVQPGRSLRLSCAASGFTFSTYGMHWVRQAPGKGLEWVAVIWYDGSNKYYADSVKGRFTISRDNSKNTLYLQMNSLRAEDTAVYYCARGHYDSSGPRDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 170 - protein, 448 aa, Artificial Sequence
  Description of Artificial Sequence: Synthetic polypeptide
QVQLVESGGGVVQPGRSLRLSCAASGFTFSSYGMHWVRQAPGQGLEWVALISYDGSNKYYADSVKGRFTISRDKSKNTLYLQMNSLRAEDTAVYYCAREANWGYNYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 171 - protein, 448 aa, Artificial Sequence
  Description of Artificial Sequence: Synthetic polypeptide
QVQLQQWGAGLLKPSETLSLTCAVYGGSFSDYYWNWIRQPPGKGPEWIGEINHSGTTNYNPSLKSRVTISVDTSKNQFSLKLSSVTAADTAVYYCVGILRYFDWLEYYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 172 - protein, 445 aa, Artificial Sequence
  Description of Artificial Sequence: Synthetic polypeptide
QVQLVQSGAEVKKPGASVKVSCKASGYTFTSYDINWVRQATGQGLEWMGWMNPHSGNTGYAQKFQGRVTMTRNTSINTAYMELSSLRSEDTAVYYCAKYNWNYGAFDFWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 173 - protein, 445 aa, Artificial Sequence
  Description of Artificial Sequence: Synthetic polypeptide
EVQLLESGGGLVQPGGSLRLSCAASGFTFSSYAMSWVRQAPGKGLEWVSAISGSGRTTYSADSVKGRFTISRDNSKNTLYLQMNSLRAEDTAVYYCAKEQQWLVYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 174 - protein, 453 aa, Artificial Sequence
  Description of Artificial Sequence: Synthetic polypeptide
QVQLQESGPGLVKPSQTLSLTCTVSGGSITSGVYYWNWIRQHPGKGLEWIGYLYYSGSTYYNPSLKSRLTISADMSKNQFSLKLSSVTVADTAVYYCARDGITMVRGVTHYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 175 - protein, 443 aa, Artificial Sequence
  Description of Artificial Sequence: Synthetic polypeptide
QVQLQQWGAGLLKPSETLSLTCAVYGGSFSGYYWSWIRQPPGKGLEWIGEINHSENTNYNPSLKSRVTISLDTSNDQFSLRLTSVTAADTAVYYCARVTGTDAFDFWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 176 - protein, 449 aa, Artificial Sequence
  Description of Artificial Sequence: Synthetic polypeptide
QVQLVESGGGVVQPGRSLRLSCAASGFTFSSFGMHWVRQAPGKGLEWVALIWYDGDNKYYADSVKGRFTISRDNSKNTLYLQMNSLRAEDTAVYYCARNSGWDYFYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 177 - protein, 442 aa, Artificial Sequence
  Description of Artificial Sequence: Synthetic polypeptide
QVQLQESGPGLVKPSETLSLTCTVSGGSISSYYWSWIRQPAGKGLEWIGRIYISGSTNYNPSLENRVTMSGDTSKNQFSLKLNSVTAADTAVYYCAGSGSYSFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 178 - protein, 455 aa, Artificial Sequence
  Description of Artificial Sequence: Synthetic polypeptide
QVQLVESGGGVVQPGRSLRLSCAASGFTFSSYGLHWVRQAPGKGLEWVAVIWNDGSNKLYADSVKGRFTISRDNSKNTLYLQMNSLRAEDTAVYYCARDQYYDFWSGYPYYHYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 179 - protein, 448 aa, Artificial Sequence
  Description of Artificial Sequence: Synthetic polypeptide
EVQLVESGGGLVKPGGSLRLSCAASGFTFSSYSMNWVRQAPGKGLEWVSSISSSSTYIYYADSVKGRFTISRDNAKNSLYLQMNSLRAEDTAVYYCARDIYSSGWSYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 180 - protein, 448 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSYQFYADSVKGRFTISRDNSKNTLYLQMNSLRAEDTAVYYCARDHVWRTYRYIFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 181 - protein, 443 aa, Artificial Sequence
  Description of Artificial Sequence: Synthetic polypeptide
EVQLVQSGPEVKKPGESLKISCKGSGYSLTSYWIGWVRQMPGKGLEWMGIIYPGDSDTRYSPSFQGQVTISADTSISTAYLQWSRLKASDTAVYYCARAQLGIFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 182 - protein, 443 aa, Artificial Sequence
  Description of Artificial Sequence: Synthetic polypeptide
QVQLQQWGAGLLKPSETLSLTCAVYGGSFSGYYWSWIRQPPGKGLEWIGEINHSENTNYNPSLKSRVTISLDTSNKQFSLRLTSVTAADTAVYYCARVTGTDAFDFWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 183 - protein, 446 aa, Artificial Sequence
  Description of Artificial Sequence: Synthetic polypeptide
QLQLQESGPGLVKPSETLSLTCTVSGDSISSSSYYWGWIRQPPGKGLEWIGMIYYSGTTYYNPSLKSRVTISVDTSKNQFSLKLSSVTAADTAVYYCARVAAVYWYFDLWGRGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 184 - protein, 453 aa, Artificial Sequence
  Description of Artificial Sequence: Synthetic polypeptide
QVQLQESGPGLVKPSQTLSLTCTVSGGSITSGVYYWSWIRQLPGKGLEWIGYIYYSGSTYYNPSLKSRLTISADTSKNQFSLKLSSVTVADTAVYYCARDGITMVRGVTHYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 185 - protein, 449 aa, Artificial Sequence
  Description of Artificial Sequence: Synthetic polypeptide
QVQLQQSGPGLVKPSQTLSLTCAISGDSVSSNSATWNWIRQSPSRGLEWLGRTYYRSKWYNDYAVSVKSRITINPDTSKNQFSLQLNSVTPEDTAVYYCVGIVVVPAVLFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 186 - protein, 455 aa, Artificial Sequence
  Description of Artificial Sequence: Synthetic polypeptide
QVQLVESGGGVVQPGRSLRLSCAASGFTFSNYGMHWVRQAPGKGLEWVAVIWNDGNNKYYADSVKGRFTISRDNSKNTLYLQMNSLRAEDTAVYYCARDQNYDFWNGYPYYFYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 187 - protein, 448 aa, Artificial Sequence
  Description of Artificial Sequence: Synthetic polypeptide
QVQVVESGGGLVKPGGSLRLSCAASGFTFSDSYMSWIRQAPGKGLEWISSISSSGSIVYFADSVKGRFTISRDIAKNSLYLHMNSLRAEDTAVYYCARETFSSGWFDAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 188 - protein, 448 aa, Artificial Sequence
  Description of Artificial Sequence: Synthetic polypeptide
EVQLVESGGGLVKPGGSLRLSCAASGFTFSSYSMSWVRQAPGKGLEWVSSISSSSTYIYYADSLKGRFTISRDNAKNSLFLQVNSLRAEDSAVYYCARDRWSSGWNEGFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 189 - protein, 443 aa, Artificial Sequence
  Description of Artificial Sequence: Synthetic polypeptide
QVQLVESGGGVVQPGRSLRLSCAASGFTFSNYGMHWVRQAPGKGLEWVAITSYGGSNKNYADSVKGRFTISRDNSKNTLYLQMNSLRAEDTAVYYCAREAGYSFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 190 - protein, 447 aa, Artificial Sequence
  Description of Artificial Sequence: Synthetic polypeptide
EVQLLGSGGGLVQPGGSLRLSCAASGFTFNHYAMSWVRQAPGKGLEWVSAISGSGAGTFYADSMKGRFTISRDNSENTLHLQMNSLRAEDTAIYYCAKDLRIAVAGSFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 191 - protein, 455 aa, Artificial Sequence
  Description of Artificial Sequence: Synthetic polypeptide
QVQLVESGGGVVQPGRSLRLSCAASGFNFSSYGMHWVRQAPGKGLEWVAVIWYDGSNKYYADSVKGRFTISRDNSKNTLYLQMNSLRAEDTAVFYCARDQYFDFWSGYPFFYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 192 - protein, 448 aa, Artificial Sequence
  Description of Artificial Sequence: Synthetic polypeptide
EVQLLESGGGLVQPGGSLRLSCAASGFTFSSYAMSWVRQAPGKGLEWVSVISDSGGSTYYADSVKGRFTISRDNSKNTLYLQMNSLRAEDTAVYYCAKDHSSGWYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 193 - protein, 451 aa, Artificial Sequence
  Description of Artificial Sequence: Synthetic polypeptide
QVQLVQSGAEVKTPGASVRVSCKASGYTFTNYGISWVRQAPGQGLEWMGWISAYNGYSNYAQKFQDRVTMTTDTSTSTAYMELRSLRSDDTAVYYCAREEKQLVKDYYYYGMDVWGQGSTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 194 - protein, 448 aa, Artificial Sequence
  Description of Artificial Sequence: Synthetic polypeptide
EVQLLESGGGLVQPGGSLRLSCAASGFTFSSYAMSWVRQSPGKGLEWVSVISGSGGDTYYADSVKGRFTISRDNSKNTLYLQMNSLRAEDTAVYYCAKDHTSGWYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 195 - protein, 447 aa, Artificial Sequence
  Description of Artificial Sequence: Synthetic polypeptide
EVQLLESGGGLVQPGGSLRLSCAASGFTFRNYAMSWVRQAPGKGLEWVSGISGSSAGTYYADSVKGRFTISRDNSKNTLFLQMDSLRAEDTAVYYCAQDWSIAVAGTFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 196 - protein, 441 aa, Artificial Sequence
  Description of Artificial Sequence: Synthetic polypeptide
QVQLQESGPGLVKPSETLSLTCTVSDGSISSYYWNWIRQPAGKGLEWIGRIYTSGSTNYNPSLKSRVTMSVDTSKNQFSLNLTSVTAADTAVYYCARGPLWFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 197 - protein, 451 aa, Artificial Sequence
  Description of Artificial Sequence: Synthetic polypeptide
QVQLVQSGAEVKKPGASVKVSCKVSGYTLTELSIHWVRQAPGKGLEWMGGFDPEDGETIYAQKFQGRVTMTEDTSTDTAYMELSSLRSEDTAVYYCATHSGSGRFYYYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 198 - protein, 446 aa, Artificial Sequence
  Description of Artificial Sequence: Synthetic polypeptide
QLQLQESGPGLVKPSETLSLTCTVSGGSISSSSYYWGWIRQPPGKGLEWIGSIYYSGTTYYNPSLKSRVTISVDTSKNQFSLKLSSVTAADTAVYYCARVAAVYWYFDLWGRGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 199 - protein, 448 aa, Artificial Sequence
  Description of Artificial Sequence: Synthetic polypeptide
QVQLVQSGAEVKKTGASVKVSCKASGYTFTSHDINWVRQATGHGLEWMGWMNPYSGSTGLAQRFQDRVTMTRNTSISTAYMELSSLRSEDTAVYYCARDLSSGYYYYGLDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 200 - protein, 450 aa, Artificial Sequence
  Description of Artificial Sequence: Synthetic polypeptide
QVQLVQSGAEVKKPGASVKVSCKASGYPFIGYYMHWVRQAPGQGLEWMGWINPDSGGTNYAQKFQGRVTMTRDTSITTAYMELSRLRSDDTAVFYCARGGYSYGYEDYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 201 - protein, 443 aa, Artificial Sequence
  Description of Artificial Sequence: Synthetic polypeptide
QVQLQQWGAGLLKPSETLSLTCAVYGGSFSGYYWSWIRQPPGKGLEWIGEINHSENTNYNPSLKSRVTISLDTSHDQFSLRLTSVTAADTAVYYCARVTGTDAFDFWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 202 - protein, 443 aa, Artificial Sequence
  Description of Artificial Sequence: Synthetic polypeptide
QVQLQESGPGLVKPSQTLSLTCTVSNGSINSGNYYWSWIRQHPGKGLEWIGYIYHSGSAYYNPSLKSRVTISVDTSKNQFSLKLSSVTAADTAVYYCARTTGASDIWGQGIMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 203 - protein, 447 aa, Artificial Sequence
  Description of Artificial Sequence: Synthetic polypeptide
QVQVVQSGTEVKKPGASVKVSCKASGYTFTGYYIHWVRQAPGQGLEWMGWINPNSGGTNYAQKFRGRVTMTRDTSISTAYMELSRLRSDDTAVYYCAREEDYSDHHYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 204 - protein, 442 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLRLSSVTAADTAVYYCARGITGTIDFWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 205 - protein, 451 aa, Artificial Sequence
  Description of Artificial Sequence: Synthetic polypeptide
EVQLVESGGGLVQPGGSLRLSCAASGFTFSSYSMNWVRQAPGKGLEWISYISSGSSTIYHADSVKGRFTISRDNAKNSLYLQMNSLRDEDTAVYYCAREGYYDSSGYYYNGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 206 - protein, 448 aa, Artificial Sequence
  Description of Artificial Sequence: Synthetic polypeptide
QVQLQQSGPGLVKPSQTLSLTCAISGDSVSSNSAAWNWIRQSPSRGLEWLGRTYYRSKWYNDYAVSVKSRITITPDTSKNQFSLQLKSVTPEDTAIYYCAREGSWSSFFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 207 - protein, 5 aa, Artificial Sequence
  Description of Artificial Sequence: Synthetic peptide
GGGGS

SEQ ID NO: 208 - protein, 10 aa, Artificial Sequence
  Description of Artificial Sequence: Synthetic peptide
GGGGSGGGGS

SEQ ID NO: 209 - protein, 15 aa, Artificial Sequence
  Description of Artificial Sequence: Synthetic peptide
GGGGSGGGGSGGGGS

SEQ ID NO: 210 - protein, 20 aa, Artificial Sequence
  Description of Artificial Sequence: Synthetic peptide
GGGGSGGGGSGGGGSGGGGS

SEQ ID NO: 211 - protein, 25 aa, Artificial Sequence
  Description of Artificial Sequence: Synthetic peptide
GGGGSGGGGSGGGGSGGGGSGGGGS

SEQ ID NO: 212 - protein, 30 aa, Artificial Sequence
  Description of Artificial Sequence: Synthetic polypeptide
GGGGSGGGGSGGGGSGGGGSGGGGSGGGGS

SEQ ID NO: 213 - protein, 35 aa, Artificial Sequence
  Description of Artificial Sequence: Synthetic polypeptide
GGGGSGGGGSGGGGSGGGGSGGGGSGGGGSGGGGS

SEQ ID NO: 214 - protein, 40 aa, Artificial Sequence
  Description of Artificial Sequence: Synthetic polypeptide
GGGGSGGGGSGGGGSGGGGSGGGGSGGGGSGGGGSGGGGS

SEQ ID NO: 215 - protein, 45 aa, Artificial Sequence
  Description of Artificial Sequence: Synthetic polypeptide
GGGGSGGGGSGGGGSGGGGSGGGGSGGGGSGGGGSGGGGSGGGGS

SEQ ID NO: 216 - protein, 50 aa, Artificial Sequence
  Description of Artificial Sequence: Synthetic polypeptide
GGGGSGGGGSGGGGSGGGGSGGGGSGGGGSGGGGSGGGGSGGGGSGGGGS

SEQ ID NO: 217 - protein, 108 aa, Artificial Sequence
  Description of Artificial Sequence: Synthetic polypeptide
DIQMTQSPSSLSASVGDRVTITCRTSQSISSYLNWYQQKPGKAPNLLIYAASSLQSGVPSRFSGSGSGTDFTLTISGLQPEDFSTYYCQQSYSTSLTFGGGTKVEIKR

SEQ ID NO: 218 - protein, 108 aa, Artificial Sequence
  Description of Artificial Sequence: Synthetic polypeptide
DIQMTQSPSSLSASVGDRVTITCRTSQSISNYLNWYQQKPGKAPNLLIYAASSLQSGVPSRFSGSGSGTDFTLTISGLQPEDFSTYYCQQSYSTSLTFGGGTKVEIKR

SEQ ID NO: 219 - protein, 108 aa, Artificial Sequence
  Description of Artificial Sequence: Synthetic polypeptide
DIQMTQSPSSLSASVGDRITITCRASQIISRYLNWYQQNPGKAPKLLISAASSLQSGVPSRFSGSGSGPDFTLTISSLQPEDFTTYYCQQSYSSPLTFGGGTKVEVKR

SEQ ID NO: 220 - protein, 108 aa, Artificial Sequence
  Description of Artificial Sequence: Synthetic polypeptide
DIQMTQSPSSVSSSVGDRVTITCRASQGISRWLAWYQQKPGKAPKLLIYAASSLKSGVPSRFSGSGSGTDFTLTISSLQPEDFATYYCQQANSFPPTFGQGTKVEIKR

SEQ ID NO: 221 - protein, 108 aa, Artificial Sequence
  Description of Artificial Sequence: Synthetic polypeptide
DIQMTQSPSSLSASVGDRVTITCRASQNINNYLNWYRQKPGKAPELLIYTTSSLQSGVPSRFSGSGSGTDFTLTISSLETEDFETYYCQQSYSTPLTFGGGTKVEIKR

SEQ ID NO: 222 - protein, 109 aa, Artificial Sequence
  Description of Artificial Sequence: Synthetic polypeptide
SYVLTQPPSVSVAPGQTARITCGGNNIGSKSVQWYQQKPGQAPVLVVYDDSDRPSGIPERFSGSNSGNTASLTISRVEAGDEADYYCQVWDSSSDHVVFGGGTKLTVLG

SEQ ID NO: 223 - protein, 109 aa, Artificial Sequence
  Description of Artificial Sequence: Synthetic polypeptide
SYVLTQPPSVSVAPGQTARITCGGNNIGSKSVHWYQQKPGQAPVLVVYDDSDRPSGIPERFSGSNSGNTATLTISRVEAGDEADYYCQVWDSSSDHVVFGGGTKLTVLG

SEQ ID NO: 224 - protein, 108 aa, Artificial Sequence
  Description of Artificial Sequence: Synthetic polypeptide
SYELTQPHSVSVATAQMARITCGGNNIGSKAVHWYQQKPGQDPVLVIYCDSNRPSGIPERFSGSNPGNTATLTISRIEAGDEADYYCQVWDSSSDGVFGGGTKLTVLG

SEQ ID NO: 225 - protein, 108 aa, Artificial Sequence
  Description of Artificial Sequence: Synthetic polypeptide
SYELTQPHSVSVATAQMARITCGGNNIGSKTVHWFQQKPGQDPVLVIYSDSNRPSGIPERFSGSNPGNTATLTISRIEAGDEADYYCQVWDSSCDGVFGGGTKLTVLG

SEQ ID NO: 226 - protein, 108 aa, Artificial Sequence
  Description of Artificial Sequence: Synthetic polypeptide
SYELTQPHSVSVATAQMARITCGGNNIGSKAVHWYQQKPGQDPVLVIYSDSNRPSGIPERFSGSNPGNTATLTISRIEAGDEADYYCQVWDSSSDGVFGGGTKLTVLG

SEQ ID NO: 227 - protein, 107 aa, Artificial Sequence
  Description of Artificial Sequence: Synthetic polypeptide
SYELTQPPSVSVSPGQTASITCSGDKLGDKYACWYQQKPGQSPVLVIYQDNERPSGIPERFSGSNSGNTATLTISGTQAMDEADYYCQAWDSTTVVFGGGTKLTVLG

SEQ ID NO: 228 - protein, 114 aa, Artificial Sequence
  Description of Artificial Sequence: Synthetic polypeptide
DVVMTQSPLSLPVTLGQPASISRRSSPSLVYSDGNTYLNCFQQRPGHSPRRLIYKGSNWDSGVPDRFSGSGSGTDFTLKISRVEAEDVGIYYCIQDTHWPTCSFGQGTKLEIKR

SEQ ID NO: 229 - protein, 108 aa, Artificial Sequence
  Description of Artificial Sequence: Synthetic polypeptide
DIQMTQSPSSLSASVGDRVTITCRASQDIRNDLGWYQQKPGKAPKRLIYAASNLQRGVPSRFSGSGSGTEFTLTISTLQPEDFATYSCLQHNSYPLTFGGGTKVEIKR

SEQ ID NO: 230 - protein, 108 aa, Artificial Sequence
  Description of Artificial Sequence: Synthetic polypeptide
DIQMTQSPSSLSASVGDRVTITCRASQGIRNDLGWYQQKPGKAPKRLIYAASNLQSGVPSRFSGSGSGTKFTLTINSLQPEDFATYYCLQLNGYPLTFGGGTKVEIKR

SEQ ID NO: 231 - protein, 108 aa, Artificial Sequence
  Description of Artificial Sequence: Synthetic polypeptide
DIQMTQSPSSLSASVGDRVTITCRASQDIRNDLGWYQQKPGKAPKRLIYAASNLQRGVPSRFSGSGSGTEFTLTISTLQPDDFATYSCLQHNSYPLTFGGGTKVEIKR

SEQ ID NO: 232 - protein, 105 aa, Artificial Sequence
  Description of Artificial Sequence: Synthetic polypeptide
SYDLTQPPSVSVSPGQTASITCSGDKLGDKYVCWYQQKPGQSPVLVIYQDSKRPSGIPERFSGSNSGNTATLTISGIQAMDEADYYCQAWDSRVFGGGTKLTVLG

SEQ ID NO: 233 - protein, 107 aa, Artificial Sequence
  Description of Artificial Sequence: Synthetic polypeptide
SYEMTQPLSVSVALGQTARITCGGNNIGSKNVHWYQQKPGQAPVLVIYRDSKRPSGIPERFSGSNSGNTATLTISRAQAGDEADYYCQVWDSSSVVFGGGTKLTVLG

SEQ ID NO: 234 - protein, 107 aa, Artificial Sequence
  Description of Artificial Sequence: Synthetic polypeptide
SYELTQPLSVSVALGQTARIPCGGNDIGSKNVHWYQQKPGQAPVLVIYRDRNRPSGIPERFSGSNSGNTATLTISRAQAGDEADYYCQVWDSNPVVFGGGTKLTVLG

SEQ ID NO: 235 - protein, 107 aa, Artificial Sequence
  Description of Artificial Sequence: Synthetic polypeptide
SYELTQPLSVSVALGQTARITCGGNNIGSKNVHWYQQKPGQAPVLVIYRDRNRPSGIPERFSGSNSGNTATLTISRAQAGDEADYYCQVWDSSTVVFGGGTKLTVLG

SEQ ID NO: 236 - protein, 107 aa, Artificial Sequence
  Description of Artificial Sequence: Synthetic polypeptide
SYELTQPLSVSVALGQTARLTCGGNNIGSINVHWYQQKPGQAPVLVIYRDRNRPSGIPERFSGSNSGNTATLTISRAQAGDEADYYCQLWDSSTVVFGGGTKLTVLG

SEQ ID NO: 237 - protein, 107 aa, Artificial Sequence
  Description of Artificial Sequence: Synthetic polypeptide
SYELTQPLSVSVALGQTARITCGGNNIGSYNVFWYQQKPGQAPVLVIYRDSKRPSGIPERFSGSNSGNTATLTISRAQAGDEADYHCQVWDSSTVVFGGGTKLTVLG

SEQ ID NO: 238 - protein, 108 aa, Artificial Sequence
  Description of Artificial Sequence: Synthetic polypeptide
EIVLTQSPGTLSLSPGERATLSCRASQSVSSIYLAWYQQKPGQAPRLLIYGASSRATGIPDRFSGSGSGTDFTLTISRLEPEDFAVYYCQQYGSSCSFGQGTKLEIKR

SEQ ID NO: 239 - protein, 108 aa, Artificial Sequence
  Description of Artificial Sequence: Synthetic polypeptide
EIVLTQSPGTLSLSPGERATLSCRASQSVSNSYLAWYQQKPGQAPRLLIYGAFSRATGIPDRFSGSGSGTDFTLTISRLEPEDFAVYYCQQFGRSFTFGGGTKVEIRR

SEQ ID NO: 240 - protein, 108 aa, Artificial Sequence
  Description of Artificial Sequence: Synthetic polypeptide
EVVLTQSPGTLSLSPGERATLSCRASQTVRNNYLAWYQQQPGQAPRLLIFGASSRATGIPDRFSGSGSGTDFTLTISRLEPEDFAVYYCQQFGSSLTFGGGTKVEIKR

SEQ ID NO: 241 - protein, 108 aa, Artificial Sequence
  Description of Artificial Sequence: Synthetic polypeptide
EIVLTQSPGTLSLSPGERATLSCRASQSVRNSYLAWYQQQPGQAPRLLIYGAFSRASGIPDRFSGSGSGTDFTLTISRLEPEDFAVYYCQQFGSSLTFGGGTKVEIKR

SEQ ID NO: 242 - protein, 108 aa, Artificial Sequence
  Description of Artificial Sequence: Synthetic polypeptide
EIVLTQSPGTLSLSPGERATLSCRASQTIRNSYLAWYQQQPGQAPRLLIYGAFSRATGIPDRFSGGGSGTDFTLTISRLEPEDFAVYYCQQFGSSLTFGGGTKVEIKR

SEQ ID NO: 243 - protein, 108 aa, Artificial Sequence
  Description of Artificial Sequence: Synthetic polypeptide
EIVLTQSPGTLSLSPGERATLSCRASQSVRNSYLAWYQQQPGQAPRLLIYGAFSRATGIPDRFSGSGSGTDFTLTISRLEPEDFAVYYCQQFGSSLTFGGGTKVEIKR

SEQ ID NO: 244 - protein, 108 aa, Artificial Sequence
  Description of Artificial Sequence: Synthetic polypeptide
EILMTQSPATLSVSPGERATLSCRASQSVNSNLAWYQQKPGQAPRLLIYGTSTRATGVPARFGGSGSGTEFTLTISSLQSEDFAFYYCQQYNTWPWTFGQGTKVEIKR

SEQ ID NO: 245 - protein, 108 aa, Artificial Sequence
  Description of Artificial Sequence: Synthetic polypeptide
EILMTQSPATLSVSPGERATLSCRASQSVSSNLAWYQQKPGQSPRLLIYGASTRATGIPARFGGSGSGTDFTLTISSLQSEDFAFYYCQQYNTWPWTFGQGTKVEIKR

SEQ ID NO: 246 - protein, 110 aa, Artificial Sequence
  Description of Artificial Sequence: Synthetic polypeptide
EIVLTQSPGTLSLSPGERATLSCRASQSVSRNYLAWYQQKPGQAPRLLIYGASSRATGVPDRFSGSGSGTDFTLTISRLEPEDFAVYYCQQYGSSSLCSFGQGTNLDIRR

SEQ ID NO: 247 - protein, 108 aa, Artificial Sequence
  Description of Artificial Sequence: Synthetic polypeptide
EMVMTQSPATLSVSPGERATLSCRASQSVSSQLAWYQEKPGRAPRLLIYGASNRAIDIPARLSGSGSGTEFTLTISSLQSEDFAVYYCQQYNNWPWTFGQGTKVEFKR

SEQ ID NO: 248 - protein, 108 aa, Artificial Sequence
  Description of Artificial Sequence: Synthetic polypeptide
EIVMTQSPATLSVSPGERVTLSCRASQSVSSNLAWYQQKPGQAPRLLIHGSSNRAIGIPARFSGSGSGTEFTLTISSLQSADFAVYNCQQYEIWPWTFGQGTKVEIKR

SEQ ID NO: 249 - protein, 111 aa, Artificial Sequence
  Description of Artificial Sequence: Synthetic polypeptide
QSVLTQPPSVSAAPGQKVTISCSGSSSNIGNNYVAWYQQLPGTAPKLLIYDNDKRPSGIPDRFSGSKSGTSATLGITGLQTGDEADYYCGTWDSSLSAVVFGGGTKLTVLG

SEQ ID NO: 250 - protein, 111 aa, Artificial Sequence
  Description of Artificial Sequence: Synthetic polypeptide
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAVVFGGGTKLTVLG

SEQ ID NO: 251 - protein, 114 aa, Artificial Sequence
  Description of Artificial Sequence: Synthetic polypeptide
DIVMTQTPLSLPVTPGEPASISCRSSQSLLNSDDGNTYLDWYLQKPGQSPQLLIYTLSYRASGVPDRFSGTGSGTEFTLKISRVEAEDVGVYYCMQRLEFPITFGQGTRLEIKR

SEQ ID NO: 252 - protein, 114 aa, Artificial Sequence
  Description of Artificial Sequence: Synthetic polypeptide
DFVMTQTPLSLPVTPGEPASISCRSSQSLLNSDDGNTYLDWYLQKPGQSPQLLIYTLSYRASGVPDRFSGSGSGTDFTLKISRVEAEDVGVYYCMQRIEFPITFGQGTRLEIKR

SEQ ID NO: 253 - protein, 107 aa, Artificial Sequence
  Description of Artificial Sequence: Synthetic polypeptide
SYELTQPLSVSVALGQTARITCGGNNIGSKNVHWYQQKPGQAPVVVIYRDSKRPSGIPERFSGSNSGNTATLTISRAQAGDEADYYCQVWDSSPVVFGGGTKLTVLG

SEQ ID NO: 254 - protein, 108 aa, Artificial Sequence
  Description of Artificial Sequence: Synthetic polypeptide
DIQMTQSPSSLSVSVGDRVTITCRASQDIRNDLAWYQQTPGKAPKRLIYASSSLQSGVPSRFSGTGSGTEFTLTISSLQPEDFATYFCLQRNSYPLTFGGGTKVEIKR

SEQ ID NO: 255 - protein, 114 aa, Artificial Sequence
  Description of Artificial Sequence: Synthetic polypeptide
DIVMTQTPLSLPVIPGEPASIFCRSSQSLLNSDAGTTYLDWYLQKPGQSPQLLIYTLSFRASGVPDRFSGSGSGTDFTLKITRVEAEDVGVYYCMQRIEFPITFGQGTRLEIKR

SEQ ID NO: 256 - protein, 108 aa, Artificial Sequence
  Description of Artificial Sequence: Synthetic polypeptide
DIQMTQSPSSLSASIGDRVTITCRASQNIRTYLNWYQQKPGKAPKLLIYVASSLESGVPSRFSGTGSGTDFALTISSLQPEDFATYYCQQSDSIPRTFGQGTKVEIKR

SEQ ID NO: 257 - protein, 108 aa, Artificial Sequence
  Description of Artificial Sequence: Synthetic polypeptide
DIQMTQSPSSLSASVGDRVTITCRASQRISSYLNWYQQKPGKAPKFLIYAVSSLQSGVPSRFSGSGSGTDFTLTISSLEPEDFATYYCQQSYSATFTFGPGTKVDIKR

SEQ ID NO: 258 - protein, 108 aa, Artificial Sequence
  Description of Artificial Sequence: Synthetic polypeptide
EIVLTQSPDFQSVTPKEKVTITCRASQDIGNSLHWYQQKPDQSPKLLIKFASQSFSGVPSRFSGSGSGTDFALTINSLEAEDAATYYCHQSSDLPLTFGGGTKVDIKR

SEQ ID NO: 259 - protein, 108 aa, Artificial Sequence
  Description of Artificial Sequence: Synthetic polypeptide
DIQMTQSPSSLSTSVGDRVTITCRASQNIRSYLNWYQLKPGKAPKVLIYGASNLQSGVPSRFSGSGSGTDFTLTISNLQSEDFAIYYCQQSYNTPCSFGQGTKLEIKR

SEQ ID NO: 260 - protein, 114 aa, Artificial Sequence
  Description of Artificial Sequence: Synthetic polypeptide
DIVMTQTPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPITFGQGTRLEIKR

SEQ ID NO: 261 - protein, 108 aa, Artificial Sequence
  Description of Artificial Sequence: Synthetic polypeptide
DIQMTQSPSSLSASVGDRVTFTCQASQDINIYLNWYQQKPGKAPKLLIYDVSNLETGVPSRFSGSGSGTDFTFTISSLQPEDIATYFCQQYDNLPFTFGPGTKVDLKR

SEQ ID NO: 262 - protein, 114 aa, Artificial Sequence
  Description of Artificial Sequence: Synthetic polypeptide
DIVLTQTPLSLPVTPGEPASISCRSSQSLLDSDDGDTYLDWYLQKPGQSPQLLIYTLSYRASGVPDRFSGSGSGTDFTLKISRVEAEDVGVYYCMQHIEFPSTFGQGTRLEIKR

SEQ ID NO: 263 - protein, 108 aa, Artificial Sequence
  Description of Artificial Sequence: Synthetic polypeptide
DIQMTQSPSSLSASIGDRVTITCQASQGISNYLNWYQQKPGKAPKLLIYDASNLETGVPSRFSGSGSGTDFTFTISSLQPEDIATYYCHQYDDLPLTFGGGTKVEIRR

SEQ ID NO: 264 - protein, 108 aa, Artificial Sequence
  Description of Artificial Sequence: Synthetic polypeptide
DIQMTQSPSSLSASVGDRVTITCQASQDITKYLNWYQQKPGKAPKLLIYDTFILETGVPSRFSGSGSGTDFTFTISSLQPEDIATYYCQQYDNLPLTFGQGTRLEIKR

SEQ ID NO: 265 - protein, 112 aa, Artificial Sequence
  Description of Artificial Sequence: Synthetic polypeptide
NFILTQPHSVSESPGKTVTISCTRSSGSIASDYVQWYQQRPGSSPTTVIYEDKERSSGVPDRFSGSIDSSSNSASLTISGLKTEDEADYYCQSYDRNNHVVFGGGTKLTVLG

SEQ ID NO: 266 - protein, 109 aa, Artificial Sequence
  Description of Artificial Sequence: Synthetic polypeptide
SYELTQPPSVSVSPGQTARITCSGDALPKKYAYWYQQKSGQAPVLVIYEDSKRPSGIPERFSGSISGTMATLTISGAQVEDEADYYCYSTDSSVNHVVFGGGTKLTVLG

SEQ ID NO: 267 - protein, 107 aa, Artificial Sequence
  Description of Artificial Sequence: Synthetic polypeptide
SYDLTQPPSVSVSPGQTASITCSGDELGDKYACWYQQKPGQSPVLVIYQDTKRPSGIPERFSGSNSGNTATLTISGTQAMDEADYYCQAWDSGTVVFGGGTKLTVLG

SEQ ID NO: 268 - protein, 108 aa, Artificial Sequence
  Description of Artificial Sequence: Synthetic polypeptide
DIQMTQSPSSLSASVGDRVTITCRASQDIRNDLGWYQQKPGKAPNRLIYAASSLQFGVPSRFSGSGSGTEFTLTISSLQPEDFATYYCLQHSSYPLTFGGGTRVEIKR

SEQ ID NO: 269 - protein, 109 aa, Artificial Sequence
  Description of Artificial Sequence: Synthetic polypeptide
DIQMTQSPSSVSASVGDRVTITCRASQGISSWLAWYQQKPGKAPKLLIYDASSLQSGVPSRFSGSGSGTDFTLTISSLQPEDFATYYCQQTNSFPPWTFGQGTKVEIKR

SEQ ID NO: 270 - protein, 108 aa, Artificial Sequence
  Description of Artificial Sequence: Synthetic polypeptide
DIQMTQSPSFLSASVGDRVTITCRASQTISSYLNWHQQKPGKAPKLLIYAASSLQSGVPSRFSGSGSGTDFSLTISSLQPEDFATYYCQQSYSTPLTFGGGTKVEIKR

SEQ ID NO: 271 - protein, 108 aa, Artificial Sequence
  Description of Artificial Sequence: Synthetic polypeptide
EVVLTQSPATLSVSPGGRATLSCRASQSVSDILAWYQQKPGQAPRLLIYGASTRATGIPARFSGGGSGTEFTLTISSLQSEDFAVYFCQQYNNWPLTFGGGTKVEIKR

SEQ ID NO: 272 - protein, 111 aa, Artificial Sequence
  Description of Artificial Sequence: Synthetic polypeptide
QSVLTQPPSVSAAPGQKVTISCSGSSSNIGINYVSWYQQLPGTAPKLLIYDNNKRPSGIPDRFSGSKSGTSATLGITGLQTGDEADYCCGTWDSSLSAVVFGGGTKLTVLG

SEQ ID NO: 273 - protein, 113 aa, Artificial Sequence
  Description of Artificial Sequence: Synthetic polypeptide
DIVMTQSPLSLPVTPGEPASISCRSSQSLLHSNGYNYLDWYLQKPGQSPQLLIYLGSNRASGVPDRFSGRGSGTDFSLKISRVEAEDVGIYYCMQALQTPFTFGPGTNVDIKQ

SEQ ID NO: 274 - protein, 109 aa, Artificial Sequence
  Description of Artificial Sequence: Synthetic polypeptide
ENVLTQSPGTLSLSPGERATLSCRASQSVRSSYLAWYQQRPGQAPRLLIFGASRRATGIPDRFSGSGSGTDFTLTISRLEPEDFAVYYCQQYGSSPRSFGQGTKLEIKR

SEQ ID NO: 275 - protein, 113 aa, Artificial Sequence
  Description of Artificial Sequence: Synthetic polypeptide
DIVMTQSPLSLPVTPGEPASISCRSSQSLQHSNGYNYLDWYLQKPGQSPQLLIYLDSNRASGVPDRFSGSGSGTDFTLKISRVEAEDIGVYYCMQGLQTPPTFGGGTKVEIKR

SEQ ID NO: 276 - protein, 108 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHKSYPFTFGPGTKMDIKG

SEQ ID NO: 277 - protein, 107 aa, Artificial Sequence
  Description of Artificial Sequence: Synthetic polypeptide
EIVMTQSPVTLSVSPGERAIISCRASQSVSSNVAWYQQKPGQTPRLLIYGASTRATGLPTRFSGSGSGTVFTLTISSLQPEDFAVYYCQQFSNSITFGQGTRLEIKR

SEQ ID NO: 278 - protein, 108 aa, Artificial Sequence
  Description of Artificial Sequence: Synthetic polypeptide
DIQMAQSPSSLSASVGDRVTITCQASQDISIYLNWYQLKPGKAPKLLIYDVSNLETGVPSRFSGGGSGTDFTFTISSLQPEDIATYYCQQYDNLPLTFGPGTKVDIKR

SEQ ID NO: 279 - protein, 108 aa, Artificial Sequence
  Description of Artificial Sequence: Synthetic polypeptide
EIVVTQSPGTLSLSVGERAILSCRASQSFSSSYLAWYQQKPGQAPRLLIYGASSRATGIPDRFSGSGSGTDFTLTISRLEPEDFAVYYCQQYGSSRTFGQGTKVEIKR

SEQ ID NO: 280 - protein, 108 aa, Artificial Sequence
  Description of Artificial Sequence: Synthetic polypeptide
DIQMTQSPSSLSVSVGDRVTITCRASQDISNYLAWFQQKPGKAPKSLIYAASSLQSGVPSKFSGSGSGTDFTLTISSLQPEDFATYYCQQYNIYPRTFGQGTKVEIKR

SEQ ID NO: 281 - protein, 108 aa, Artificial Sequence
  Description of Artificial Sequence: Synthetic polypeptide
DIQMTQSPSSLSTSIGDRITITCRASQSISNYLNWFQQIPGKAPRLLIYTASSLQSGVPSRFSGSGSGTDFTLTISSLQPEDFATYYCQQSSSIPWTFGQGTKVEIKR

SEQ ID NO: 282 - protein, 113 aa, Artificial Sequence
  Description of Artificial Sequence: Synthetic polypeptide
DIVMTQSPLSLPVTPGEPASISCRSSQSLLHSNGFNYLDWYLQKPGQSPQVLIYLGSNRASGVPDRFSGSGSGTDFTLKISRVEAEDVGIYYCMQALQTLITFGQGTRLEIKR

SEQ ID NO: 283 - protein, 107 aa, Artificial Sequence
  Description of Artificial Sequence: Synthetic polypeptide
SYELTQPPSVSVSPGQTASITCSGDNLGDKYAFWYQQKPGQSPVLVIYQDNKRPSGIPERFSGSNSGNTATLTISGTQAVDEADYYCQAWDSATVIFGGGTKLTVLG

SEQ ID NO: 284 - protein, 109 aa, Artificial Sequence
  Description of Artificial Sequence: Synthetic polypeptide
DIQMTQSPSSVSASVGDRVTITCRASQDISSWLAWYQQKPGKAPKFLIYDASTLQSGVPSRFSGSGSGADFTLTINNLQPEDFATYYCQQTNSFPPWTFGQGTKVEIKR

SEQ ID NO: 285 - protein, 108 aa, Artificial Sequence
  Description of Artificial Sequence: Synthetic polypeptide
SYVLTQPPSVSVAPGQAARITCGGNDIGSKSVHWYQQKPGQAPVLVVYDDSDRPSGIPERFSGSKSGNTATLIISRVEAGEEADYYCQVWDSSSDVVFGGGTKLTVLG

SEQ ID NO: 286 - protein, 108 aa, Artificial Sequence
  Description of Artificial Sequence: Synthetic polypeptide
DLQMTQSPSSLSASVGDRVTITCQASQDIKKFLNWYQQKPGKAPNLLIYDASNLETGVPSRFSGSGSGTDFTFTISSLQPEDIATYYCQQYAILPFTFGPGTTVDIKR

SEQ ID NO: 287 - protein, 108 aa, Artificial Sequence
  Description of Artificial Sequence: Synthetic polypeptide
DIQMTQSPSSLSASVGDRVTITCRASQSISNYLNWFLQIPGKAPKLLIYAASSLQSGVPSRFSGSGSGTDFTLTINSLQPEDFGTYYCQQSSTIPWTFGQGTKVEIKR

SEQ ID NO: 288 - protein, 109 aa, Artificial Sequence
  Description of Artificial Sequence: Synthetic polypeptide
EIVLTQSPGTLSLSPGERATLSCRASQSVSRDYLAWYRQKPGQAPRLLVYGASARATGIPDRFSGSGSGTDFTLTISRLEPEDFAVYYCQQYGRSLFTFGPGTKVDIKR

SEQ ID NO: 289 - protein, 108 aa, Artificial Sequence
  Description of Artificial Sequence: Synthetic polypeptide
DIQMTQSPSSLSVSVGDRVTITCRASHDISNYLAWFQQKPGKAPKSLIYAASSLQSGVPSKFSGSGSGTDFTLTISSLQPEDFATYYCQQYNTYPRTFGQGTKVEIKR

SEQ ID NO: 290 - protein, 109 aa, Artificial Sequence
  Description of Artificial Sequence: Synthetic polypeptide
EIVLTQSPGTLSLSPGERATLSCRASPSVSSSYLAWYQQKPAQAPRLLIYGASSRATGIPDRFSGSGSGTDFTLTISRLEPEDFAVYYCHQYGTSPCSFGQGTKLEIKR

SEQ ID NO: 291 - protein, 109 aa, Artificial Sequence
  Description of Artificial Sequence: Synthetic polypeptide
DIQMTQSPSSVSASVGDRVTITCRASQGISSWLAWYQQKPGKAPKLLIYGASSLQSGVPSRFSGSGSGTDFTLTISSLQPEDFATYYCQQTNSFPPWTFGQGTKVEIKR

SEQ ID NO: 292 - protein, 109 aa, Artificial Sequence
  Description of Artificial Sequence: Synthetic polypeptide
DIQMTQSPSSVSASVGDRVTITCRASQDIDSWLVWYQQKPGKAPNLLIYAASNLQRGVPSRFSGSGSGTDFTLTIASLQPEDFATYYCQQTNSFPPWTFGQGTKVEIKR

SEQ ID NO: 293 - protein, 108 aa, Artificial Sequence
  Description of Artificial Sequence: Synthetic polypeptide
SYELSQPPSVSVSPGQTVSITCSGDNLGDKYACWYQQRPGQSPVLVIYQDTKRPSGIPERFSGSNSGNTATLTISGTQAMDEADYYCQAWDSSTTWVFGGGTKLTVLG

SEQ ID NO: 294 - protein, 111 aa, Artificial Sequence
  Description of Artificial Sequence: Synthetic polypeptide
QSVLTQPPSVSAAPGQKVTISCSGSSSNIGDNYVSWYQQFPGTAPKLLIYDNNKRPSGIPDRFSGSKSGTSATLGITGLQTGDEADYYCGTWDSSLSVMVFGGGTKLTVLG

SEQ ID NO: 295 - protein, 114 aa, Artificial Sequence
  Description of Artificial Sequence: Synthetic polypeptide
DIVLTQTPLSLPVTPGEPASISCRSSQSLLDSDDGDTYLDWYLQKPGQSPQLLIYTLSYRASGVPDRFSGSGSGTDFTLKISRVEAEDVGVYYCMQRIEFPLTFGGGTKVEIKR

SEQ ID NO: 296 - protein, 110 aa, Artificial Sequence
  Description of Artificial Sequence: Synthetic polypeptide
EIMLTQSPGTLSLSPGERATLSCRASQRVPSSYIVWYQQKPGQAPRLLIYGSSNRATGIPDRFSGSGSGTDFTLTIGRLEPEDFAVYYCQQYGSSPPWTFGQGTKVAIKR

SEQ ID NO: 297 - protein, 107 aa, Artificial Sequence
  Description of Artificial Sequence: Synthetic polypeptide
SYELTQPPSVSVSPGQTASITCSGNKLGDKYVCWYQQKPGQSPVLVIYQDSKRPSGIPERFSGSNSGNTATLTISGTQALDEADYYCQAWDSSTWVFGGGTKLTVLG

SEQ ID NO: 298 - protein, 110 aa, Artificial Sequence
  Description of Artificial Sequence: Synthetic polypeptide
EIMLTQSPGTLSLSPGERATLSCRASQRVPSSYLVWYQQKPGQAPRLLIYGASNRATGIPDRFSGSGSGTDFTLTIGRLEPEDFAVYYCQQYGSSPPWTFGQGTKVAIKR

SEQ ID NO: 299 - protein, 108 aa, Artificial Sequence
  Description of Artificial Sequence: Synthetic polypeptide
DIQMTQSPSSLSASIGDRVTITCRASQSISNYLNWFQQIPGKAPRLLIYAASSLQSGVPSRFSGSGSGTDFTLTISSLQPEDFAIYYCQQSSSIPWTFGQGTKVEIKR

SEQ ID NO: 300 - protein, 109 aa, Artificial Sequence
  Description of Artificial Sequence: Synthetic polypeptide
EIVLTQSPGTLSLSPGERATLSCRASQSVSRDYLAWYRQKPGQAPRLLIYGASSRATGIPDRFSGSGSGTDFTLTISRLEPEDFAVYYCQQYGRSLFTFGPGTTVDIKR

SEQ ID NO: 301 - protein, 109 aa, Artificial Sequence
  Description of Artificial Sequence: Synthetic polypeptide
SYELTQPPSVSVSPGQTARITCSGDAVPKKYANWYQQKSGQAPVLVIYEDSKRPSGIPERFSGSSSGTMATLTISGAQVEDEADYYCYSTDSSGNHVVFGGGTKLTVLG

SEQ ID NO: 302 - protein, 107 aa, Artificial Sequence
  Description of Artificial Sequence: Synthetic polypeptide
SYELTQPPSVSVSPGQTASITCSGDKLGDKYVCWYQQMPGQSPVLVIHQNNKRPSGIPERFSGSNSGNTATLTISGTQAMDEADYYCQAWDSSTAVFGGGTKLTVLG

SEQ ID NO: 303 - protein, 108 aa, Artificial Sequence
  Description of Artificial Sequence: Synthetic polypeptide
ETVMTQSPATLSVSPGERATLSCRARQSVGSNLIWYQQKPGQAPRLLIFGASSRDTGIPARFSGSGSGTEFTLTISSLQSEDFAVYYCQQYNNWPLTFGGGTKVEIKR

SEQ ID NO: 304 - protein, 109 aa, Artificial Sequence
  Description of Artificial Sequence: Synthetic polypeptide
EIVLTQSPGTLSLSPGERATLSCRASQSVASSYLVWYQQKPGQAPRLLIYGAFSRATGIPDRFSGSGSGTDFTLTIRRLEPEDFAVYYCQQYGTSPFTFGPGTKVDLKR

SEQ ID NO: 305 - protein, 114 aa, Artificial Sequence
  Description of Artificial Sequence: Synthetic polypeptide
DIVMTQTPLSLPVSPGEPASISCRSSQSLLDSDDGDTYLDWYLQKPGQSPQLLIYTLSYRASGVPDRFSVSGSGTDFTLKISRVEAEDVGVYYCMQRIEFPLTFGGGTKVEIKR

SEQ ID NO: 306 - protein, 114 aa, Artificial Sequence
  Description of Artificial Sequence: Synthetic polypeptide
EIVMTQTPLSLPVTPGEPASISCRSSQSLFDNDDGDTYLDWYLQKPGQSPQLLIYTLSYRASGVPDRFSGSGSGTDFTLKISRVEAEDVGVYYCMQRLEFPITFGQGTRLEIKR

SEQ ID NO: 307 - protein, 108 aa, Artificial Sequence
  Description of Artificial Sequence: Synthetic polypeptide
DIQMTQSPSSLSASVGDRVTITCRASQDISNYLAWYQQKPGKVPTLLIYAASTLLSGVPSRFSGSGSGTDFTLTISSLQPEDVAAYYCQKYYSAPFTFGPGTKVDINR

SEQ ID NO: 308 - protein, 108 aa, Artificial Sequence
  Description of Artificial Sequence: Synthetic polypeptide
DIQMTQSPSSLSASVGDRVTITCRASQGIRNDLGWYQQKPGKAPNRLIYAASSLQSGVPSRFSGSGSGTEFTLTISSLQPEDFATYYCLQHNSYPRTFGQGTKVEIKR

SEQ ID NO: 309 - protein, 113 aa, Artificial Sequence
  Description of Artificial Sequence: Synthetic polypeptide
DVVMTQCPLSLPVTLGQPASISCRSSQRLVYSDGNTYLNWVQQRPGQSPRRLIYKVSNWDSGVPDRFSGSGSGTDFTLKISRVEAEDVGVNYCMEGTHWPRDFGQGTRLEIKR

SEQ ID NO: 310 - protein, 108 aa, Artificial Sequence
  Description of Artificial Sequence: Synthetic polypeptide
DIQMTQSPSSLSASIGDRVTITCRASQSISNYLNWFQQIPGKAPRLLIYAASSLQSGVPSRFSGSGSGTDFTLTISSLQPEDFATYYCQQSSSIPWTFGQGTTVEIKR

SEQ ID NO: 311 - protein, 108 aa, Artificial Sequence
  Description of Artificial Sequence: Synthetic polypeptide
DIVMTQSPATLSVSPGERATLSCRASQSISSNLAWYQQTPGQAPRLLIYGTSIRASTIPARFSGSGSGTEFTLTISSLQSEDFAIYYCHQYTNWPRTFGQGTKVEIKR

SEQ ID NO: 312 - protein, 108 aa, Artificial Sequence
  Description of Artificial Sequence: Synthetic polypeptide
DIQMTQSPSSLSASVGDRVTITCRASQTISIYLNWYQQKPGKAPKFLIYSASSLQSGVPSRFSGSGSGTDFTLTISSLQPEDFSTYFCQQSYSSPLTFGGGTKVEIKR

SEQ ID NO: 313 - protein, 108 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQTYSAPFTFGPGTKVDIKR

SEQ ID NO: 314 - protein, 109 aa, Artificial Sequence
  Description of Artificial Sequence: Synthetic polypeptide
EIVLTQSPGTLSLSPGERATLSCRASQSVSRSHLAWYQQNSGQAPRLLIYGASSRATGIPDRFSGSGSGTDFTLTISRLEPEDFAVYYCQQYGSSPWTFGQGTKVEIKR

SEQ ID NO: 315 - protein, 108 aa, Artificial Sequence
  Description of Artificial Sequence: Synthetic polypeptide
DIQMTQSPSSLSASIRDRVTITCRASQSIGTFLNWYQQKPGTAPKLLIYAASSLQSGVPSRFSGSGSGTDFTLTISSLHPEDFASYYCQQSFSTPLTFGGGTKVEITR

SEQ ID NO: 316 - protein, 119 aa, Artificial Sequence
  Description of Artificial Sequence: Synthetic polypeptide
QVQLMQSGAEVKKPGASVKVSCKASGYTFTGYYMHWVRQAPGQGLEWMGWMNPNSGATKYAQKFQGRVTMTRDTSISTAYMELSRLRSDDTAVYYCARELGDYPFFDYWGQGTLGIVSS

SEQ ID NO: 317 - protein, 119 aa, Artificial Sequence
  Description of Artificial Sequence: Synthetic polypeptide
QVQLVQSGAEVKKPGASVKVSCRASGYTFTGYYIHWMRQAPGHGLEWMGWINPPSGATNYAQKFRGRVAVTRDTSISTVYMELSRLRSDDTAVYYCARETGTWNFFDYWGQGTLVTVSS

SEQ ID NO: 318 - protein, 120 aa, Artificial Sequence
  Description of Artificial Sequence: Synthetic polypeptide
QVQLVQSGAEVKKPGASVKVSCKASGYTFTGYYLHWVRQAPGQGLEWMGWINPNSGGTDYAQKFQGRVTMTRDTSISTAYMELSRLRSDDTAVYYCVGDAATGRYYFDNWGQGTLVTVSS

SEQ ID NO: 319 - protein, 119 aa, Artificial Sequence
  Description of Artificial Sequence: Synthetic polypeptide
QVQLVQSGAEVKRPGASVKVSCKASGYTFTGYFMHWVRQAPGQGLEWMGWINPNSGATNYAQKFHGRVTMTRDTSITTVYMELSRLRSDDTAVYYCTRELGIFNWFDPWGQGTLVTVSS

SEQ ID NO: 320 - protein, 123 aa, Artificial Sequence
  Description of Artificial Sequence: Synthetic polypeptide
EVQLVESGGGLVQPGGSLRLSCAASGFAFSSYDMHWVRQATGKGLEWVSTIDTAGDAYYPGSVKGRFTISRENAKTSLYLQMNSLRAGDTAVYYCTRDRSSGRFGDFYGMDVWGQGTAVTVSS

SEQ ID NO: 321 - protein, 123 aa, Artificial Sequence
  Description of Artificial Sequence: Synthetic polypeptide
EVQLEESGGGLVQPGGSLRLSCAASGFTFRTYDMHWVRQVTGKGLEWVSAIGIAGDTYYSDSVKGRFTISRENAKNSLYLQMNSLRVGDTAVYYCARDRSSGRFGDYYGMDVWGQGTTVTVSS

SEQ ID NO: 322 - protein, 125 aa, Artificial Sequence
  Description of Artificial Sequence: Synthetic polypeptide
EVQLVESGGDLVKPGGSLRLSCAVSGITFSNAWMSWVRQAPGKGLEWVGRIKSKTDGGTTDYAAPVKGRFTVSRDGSKNTLYLQMNSLKTEDTAVYYCTTDSSGSYYVEDYFDYWGQGTLVTVSS

SEQ ID NO: 323 - protein, 125 aa, Artificial Sequence
  Description of Artificial Sequence: Synthetic polypeptide
EVQLVESGGGLVKPGGSLRLSCAASGFTFSNAWMSWVRQAPGKGLEWVGRIIGKTDGGTTDYAAPVKGRFTISRDDSKNTLYLQMNSLKTEDTAVYYCTSDSSGSYYVEDYFDYWGQGTLVAVSS

SEQ ID NO: 324 - protein, 125 aa, Artificial Sequence
  Description of Artificial Sequence: Synthetic polypeptide
EVQLVESGGGLVKPGGSLRLACAASGITFNNAWMSWVRQAPGKGLEWVGRIKSKTDGGTTDYAAPVKGRFTISRDDSKSILYLQMNSLKSEDTAVYYCTTDSSGSYYVEDYFDYWGQGTLVTVSS

SEQ ID NO: 325 - protein, 125 aa, Artificial Sequence
  Description of Artificial Sequence: Synthetic polypeptide
QVQLVESGGGVVQPGRSLRLSCVASGFTFSSYGMHWVRQDPGKGLEWVAVISYDGSNKHYADSVKGRFTISRDNSKNTLYLQMNSLRAEDTAVYYCARELLWFGEYGVDHGMDVWGQGTTVTVSS

SEQ ID NO: 326 - protein, 123 aa, Artificial Sequence
  Description of Artificial Sequence: Synthetic polypeptide
QAQLVESGGGVVQPGRSLRLSCAASGFTFSSYGIHWVRQAPGKGLEWVAVISYDGSNKYYADSVKGRFTISRDNSKNTLYLQMNSLRAEDTAVYYCATTVTKEDYYYYGMDVWGQGTTVTVSS

SEQ ID NO: 327 - protein, 123 aa, Artificial Sequence
  Description of Artificial Sequence: Synthetic polypeptide
QVQLVESGGGVVQPGRSLRLSCAASGFTFSSYGMHWVRQAPGKGLEWVAGISYDGSNKNYADSVKGRITISRDNPKNTLYLQMNSLRAEDTAVYYCATTVTKEDYYYYGMDVWGQGTTVTVSS

SEQ ID NO: 328 - protein, 119 aa, Artificial Sequence
  Description of Artificial Sequence: Synthetic polypeptide
QVQLVESGGGVVQPGRSLRLSCAASGFTFSYYYIHWVRQAPGKGLEWVALIWYDGSNKDYADSVKGRFTISRDNSKNTLYLHVNSLRAEDTAVYYCAREGTTRRGFDYWGQGTLVTVSS

SEQ ID NO: 329 - protein, 119 aa, Artificial Sequence
  Description of Artificial Sequence: Synthetic polypeptide
QVQLVESGGGVVQPGRSLRLSCAASGFTFSSYGMHWVRQAPGKGLEWVAVIWDDGSNKYYADSVKGRFTISRDNSKNTLSLQMNSLRAEDTAVYYCAREYVAEAGFDYWGQGTLVTVSS

SEQ ID NO: 330 - protein, 118 aa, Artificial Sequence
  Description of Artificial Sequence: Synthetic polypeptide
QEQLVESGGGVVQPGRSLRLSCAVSGFTFSFYGMHWVRQAPGKGLEWVAVIWYDGSNKYYADSVKGRFTISRDNSKNTLYLQMNSLRAEDTAVYYCTRALNWNFFDYWGQGTLVTVSS

SEQ ID NO: 331 - protein, 118 aa, Artificial Sequence
  Description of Artificial Sequence: Synthetic polypeptide
QVQLVESGGGVVQPGRSLRLSCAASGFTLSNYNMHWVRQAPGKGLEWVAVLWYDGNTKYYADSVKGRVTISRDNSKNTLYLQMNSLRAEDTAVYYCARDVYGDYFAYWGQGTLVTVSS

SEQ ID NO: 332 - protein, 119 aa, Artificial Sequence; identical to SEQ ID NO: 329
  Description of Artificial Sequence: Synthetic polypeptide

SEQ ID NO: 333 - protein, 120 aa, Artificial Sequence
  Description of Artificial Sequence: Synthetic polypeptide
QVQLVESGGGVVQPGRSLRLSCTASGFTFSSYGMHWVRQAPGKGLEWVAVIWYDGSNKYHADSVKGRFTISRDDSKNALYLQMNSLRAEDTAVYYCVRDPGYSYGHFDYWGQGTLVTVSS

SEQ ID NO: 334 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKDYADSVKGRFTISRDNSKNTLYLQMNSLRAEDTAVYYCARSAVALYNWFDPWGQGTLVTVSS

SEQ ID NO: 335 - protein, 123 aa, Artificial Sequence
  Description of Artificial Sequence: Synthetic polypeptide
QVQLQESGPGLVNPSQTLSLTCTVSGGSISSDAYYWSWIRQHPGKGLEWIGYIFYSGSTYYNPSLKSRVTISVDTSKNRFSLKLSSVTAADTAVYYCARESRILYFNGYFQHWGQGTLVTVSS

SEQ ID NO: 336 - protein, 120 aa, Artificial Sequence
  Description of Artificial Sequence: Synthetic polypeptide
QVQLQESGPGLVKPSQTLSLTCAVSGGSISSGDYYWSWIRQHPGKGLEWIGYIYYSGTTYYNPSLKSRVTISVDTSKNQFSLKLTSVTAADTAVYYCARMTTPYWYFGLWGRGTLVTVSS

SEQ ID NO: 337 - protein, 120 aa, Artificial Sequence
  Description of Artificial Sequence: Synthetic polypeptide
QVQLQESGPGLVKPSQTLSLTCPVSGGSISSGDYYWTWIRQHPGKDLEWITYIYYSGSAYYNPSLKSRVTISVDTSKNQFSLKLSSVTAADTAVYYCARMTTPYWYFDLWGRGTLVTVSS

SEQ ID NO: 338 - protein, 120 aa, Artificial Sequence
  Description of Artificial Sequence: Synthetic polypeptide
QVQLQESGPGLVKPSQTLSLTCPVSGGSISSGDYYWTWIRQHPGKGLEWIAYIYYSGSTYYNPSLKSRVTISVDTSKNQFSLKLSSVTAADTAVYYCARMTTPYWYFDLWGRGTLVTVSS

SEQ ID NO: 339 - protein, 120 aa, Artificial Sequence
  Description of Artificial Sequence: Synthetic polypeptide
QVQLQESGPGLVKPSQTLSLTCPVSGGSISSGDYYWTWIRQHPGKGLEWIAYIYYTGSTYYNPSLKSRVTISVDTSKNQFSLKLSSVTAADTAVYYCARMTTPYWYFDLWGRGTLVTVSS

SEQ ID NO: 340 - protein, 120 aa, Artificial Sequence
  Description of Artificial Sequence: Synthetic polypeptide
QVQLQESGPGLVKPSQTLSLTCPVSGGSISSGDYYWTWIRQHPGKGLEWIAYIFYSGSTYYNPSLKSRVTISLDTSKNQFSLKLNSVTAADTAVYYCARMTSPYWYFDLWGRGTLVTVSS

SEQ ID NO: 341 - protein, 120 aa, Artificial Sequence
  Description of Artificial Sequence: Synthetic polypeptide
QVQLQESGPGLVKPSQTLSLTCPVSGGSISSGDYYWTWIRHHPGKGLEWIAYIYYSGSTYYNPSLKSRVTISVDTSKNQFSLKLNSVTAADTAVYYCARMTTPYWYFDLWGRGTLVTVSS

SEQ ID NO: 342 - protein, 126 aa, Artificial Sequence
  Description of Artificial Sequence: Synthetic polypeptide
QVQLQESGPGLVKPSQTLSLTCTVSGGSISSGGYYWSWIRQRPGKGLEWVGYIYYSGGTHYNPSLKSRVTISIDTSENQFSLKLSSVTAADTAVYYCARVLHYSDSRGYSYYSDFWGQGTLVTVSS

SEQ ID NO: 343 - protein, 126 aa, Artificial Sequence
  Description of Artificial Sequence: Synthetic polypeptide
QVQLQESGPGLVKPSQTLSLTCTLSGGSFSSGDYYWSWIRQHPGKGLEWIGYIYYSGSTYYNPSLKSRVTISIDTSKNQFSLKLTSVTAADTAVYYCARVLHYYDSSGYSYYFDYWGQGTLVTVSS

SEQ ID NO: 344 - protein, 120 aa, Artificial Sequence
  Description of Artificial Sequence: Synthetic polypeptide
QLQLQESGPGLVKPSETLSLTCTVSGGSISSDTSYWGWIRQPPGKGLEWIGNIYYSGTTYFNPSLKSRVSVSVDTSKNQFSLKLSSVTAADTAVFYCARLRGVYWYFDLWGRGTLVTVSS

SEQ ID NO: 345 - protein, 119 aa, Artificial Sequence
  Description of Artificial Sequence: Synthetic polypeptide
QVQLQESGPGLVKPSETLSLTCTVSGGSISSYYWSWIRQPPGKGLEWIGYIYYTGSTNYNPSLKSRVTISVDTSKNQFSLKLSSVTAADTAVYYCAREYYYGSGSYYPWGQGTLVTVSS

SEQ ID NO: 346 - protein, 119 aa, Artificial Sequence
  Description of Artificial Sequence: Synthetic polypeptide
QVQLKESGPGLVKPSETLSLTCTVSGGSISSYYWSWIRQPPGKGLEWIGYIYYSGNTNYNPSLKSRVTISVDTSKNQFSLKLSSVTAADTAVYYCAREYYYGSGSYYPWGQGTLVTVSS

SEQ ID NO: 347 - protein, 123 aa, Artificial Sequence
  Description of Artificial Sequence: Synthetic polypeptide
QIQLLESGPGLVKPSETLSLTCTVSGGSVSSGDYYWSWIRQPPGKGLEWIGFIYYSGGTNYNPSLKSRVTISIDTSKNQFSLKLNSVTAADTAVYYCARYSSTWDYYYGVDVWGQGTTVTVSS

SEQ ID NO: 348 - protein, 123 aa, Artificial Sequence
  Description of Artificial Sequence: Synthetic polypeptide
QVQLQESGPGLVKPSETLSLTCTVSGDSVSSGDNYWSWIRQPPGKGLEWIGFMFYSGSTNYNPSLKSRVTISLHTSKNQFSLRLSSVTAADTAVYYCGRYRSDWDYYYGMDVWGQGTTVTVSS

SEQ ID NO: 349 - protein, 123 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSDTRYSPSFQGQVTISADKSINTAYLQWSSLKASDTAIYFCARRASRGYRFGLAFAIWGQGTMVTVSS

SEQ ID NO: 350 - protein, 123 aa, Artificial Sequence
  Description of Artificial Sequence: Synthetic polypeptide
EVQLVQSGAEVKKPGESLKISCQGSGYSFSSYWIGWVRQMPGKGLEWMGIIYPGDSDTRYSPSFQGQVTISADKSINTAYLQWSSLKASDTAIYYCARRASRGYRYGLAFAIWGQGTMVTVSS

SEQ ID NO: 351 - protein, 120 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSETRYSPSFQGQVTISADKSISTAYLQWNSLKTSDTAMYFCATVAVSAFNWFDPWGQGTLVTVSS

SEQ ID NO: 352 - protein, 128 aa, Artificial Sequence
  Description of Artificial Sequence: Synthetic polypeptide
QVQLKESGPGLVKPSQTLSLTCTVSGGSISSGGYYWNWIRQHPGKGLEWIGYIYDSGSTYYNPSLKSRVTMSVDTSKNQFSLKLSSVTAADTAVYYCARDVLMVYTKGGYYYYGVDVWGQGTTVTVSS

SEQ ID NO: 353 - protein, 123 aa, Artificial Sequence
  Description of Artificial Sequence: Synthetic polypeptide
EVQLVQSGAEVKKPGESLKISCKGSGYSFTGYWIGWVRQLPGKGLEWMGIIYPGDSDTRYSPSFQGQVTISVDKSINTAYLQWSSLKASDTAMYYCARRASRGYSYGHAFDFWGQGTMVTVSS

SEQ ID NO: 354 - protein, 117 aa, Artificial Sequence
  Description of Artificial Sequence: Synthetic polypeptide
QVQLQQWGAGLLKPSETLSLTCSVYGGSFSGYYWTWIRQPPGKGLEWIGEINHSENTNYNPSLKSRVTISIDTSKNQFSLKLSSVTAADTAVYYCARESGNFPFDYWGQGTLVTVSS

SEQ ID NO: 355 - protein, 121 aa, Artificial Sequence
  Description of Artificial Sequence: Synthetic polypeptide
QVQLQQWGAGPLKPSETLSLTCAVYGGSISGYYWSWIRQPPGKGLEWIGEITHTGSSNYNPSLKSRVTISVDTSKNQFSLKLSSVTAADTAVYYCARGGILWFGEQAFDIWGQGTMVTVSS

SEQ ID NO: 356 - protein, 120 aa, Artificial Sequence
  Description of Artificial Sequence: Synthetic polypeptide
EVQLVESGGGLVKPGGSLRLSCTASGFTFRSYSMNWVRQAPGKGLEWVSSISSSSSYEYYVDSVKGRFTISRDIAKSSLWLQMNSLRAEDTAVYYCARSLSIAVAASDYWGKGTLVTVSS

SEQ ID NO: 357 - protein, 125 aa, Artificial Sequence
  Description of Artificial Sequence: Synthetic polypeptide
QVQLVQSGAEVKKPGASVKVSCKASGYTFTGYYKHWVRQAPGQGLEWMGWINPNSGATKYAQKFQGRVTMTRDTSISTVYMELSRLRSVDTALYYCAREVPDGIVVAGSNAFDFWGQGTMVTVSS

SEQ ID NO: 358 - protein, 129 aa, Artificial Sequence
  Description of Artificial Sequence: Synthetic polypeptide
QVHLVESGGGVVQPGRSLRLSCAASGFTFSNYGMHWVRQAPGKGLEWVAIIWYDGSNKNYADSVKGRFTISRDNSKNTLYLEMNSLRAEDTAVYYCARDQDYDFWSGYPYFYYYGMDVWGQGTTVTVSS

SEQ ID NO: 359 - protein, 120 aa, Artificial Sequence
  Description of Artificial Sequence: Synthetic polypeptide
QVQLVQSGAEVKKPGASVKVSCKASGYTFTSYDIDWVRQATGQGLEWMGWMNPNGGNTGYAQKFQGRVTMTRNTSINTAYMELSSLRSEDTAIYYCARGKEFSRAEFDYWGQGTLVTVSS

SEQ ID NO: 360 - protein, 129 aa, Artificial Sequence
  Description of Artificial Sequence: Synthetic polypeptide
QVQLVESGGGVVQPGRSLRLSCAASGFTFSNYGMRWVRQAPGKGLEWVALIWYDGSNKFYADSVKGRFTISRDNSKNTLNLQMNSLRAEDTAVYYCARDRYYDFWSGYPYFFYYGLDVWGQGTTVTVSS

SEQ ID NO: 361 - protein, 123 aa, Artificial Sequence
  Description of Artificial Sequence: Synthetic polypeptide
QVTLKESGPVLVKPTETLTLTCTVSGFSLSNPRMGVSWIRQPPGKALEWLTHIFSNDEKSYSTSLKSRLTISKDTSKSQVVLSMTNMDPVDTATYYCVRVDTLNYHYYGMDVWGQGTTVTVSS

SEQ ID NO: 362 - protein, 119 aa, Artificial Sequence
  Description of Artificial Sequence: Synthetic polypeptide
QVQLVQSGAEVKKPGASVKVSCMASGYIFTSYDINWVRQATGQGPEWMGWMNPYSGSTGYAQNFQGRVTMTRNTSINTAYMELSSLRSEDTAVYYCAKYNWNYGAFDFWGQGTMVTVSS

SEQ ID NO: 363 - protein, 125 aa, Artificial Sequence
  Description of Artificial Sequence: Synthetic polypeptide
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARADGDYPYYYYYYGMDVWGQGTTVTVSS

SEQ ID NO: 364 - protein, 121 aa, Artificial Sequence
  Description of Artificial Sequence: Synthetic polypeptide
EVQLLESGGGLVQPGGSLRLSCAASGFTFRNYAMSWVRQAPGKGLEWVSGISGSSAGTYYADSVKGRFTISRDNSKNTLFLQMDSLRAEDTAVYYCAQDWSIAVAGTFDYWGQGTLVTVSS

SEQ ID NO: 365 - protein, 118 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYNGSPYDNPSLKRRVTISIDASKNQFSLKLSSMTAADTAVYYCARGALYGMDVWGQGTTVTVSS

SEQ ID NO: 366 - protein, 116 aa, Artificial Sequence
  Description of Artificial Sequence: Synthetic polypeptide
QVQLQQWGAGLLKPSETLSLTCAVYGGSFSGYYWSWIRQPPGKGLEWIGELDHSGSINYNPSLKSRVTISVDTSKNQFSLKLTSVTAADTAVYYCARVLGSTLDYWGQGTLVTVSS

SEQ ID NO: 367 - protein, 122 aa, Artificial Sequence
  Description of Artificial Sequence: Synthetic polypeptide
EVQLVESGGGLVKPGGSLRLSCAASGFTFSSYSMNWVRQAPGKGLEWVSSISSSSTYIYYADSVKGRFTISRDNAKNSLYLQMNSLRAEDTAVYYCARDTYISGWNYGMDVWGQGTTVTVSS

SEQ ID NO: 368 - protein, 119 aa, Artificial Sequence
  Description of Artificial Sequence: Synthetic polypeptide
QVQLVQSGAEVKKPGASVKVSCKASGYTFTGYYLHWVRQAPGQGLEWMGWINPNSAATNYAPKFQGRVTVTRDTSISTAYMELSRLRSDDTAVYYCAREGGTYNWFDPWGQGTLVTVSS

SEQ ID NO: 369 - protein, 115 aa, Artificial Sequence
  Description of Artificial Sequence: Synthetic polypeptide
QVQLQESGPGLMKPSETLSLTCTVSGGSISYYYWSWIRQSPGKGLEWIGYIYYSGSTNYNPSLKSRVTMSVDTSKNQFSLKLSSVTAADTAVYYCASGTRAFDIWGQGTMVTVSS

SEQ ID NO: 370 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNNYYADSVKGRFTISRDNSKSTLFLQMNSLRAEDTAIYYCARDRAGASPGMDVWGQGTTVTVSS

SEQ ID NO: 371 - protein, 122 aa, Artificial Sequence
  Description of Artificial Sequence: Synthetic polypeptide
QVQLVQSGAEVKKPGASVKVSCKASGFTFIGYYTHWVRQAPGQGLEWMGWINPSSGDTKYAQKFQGRVTLARDTSISTAYMELSRLRSDDTAVYYCANSGWYPSYYYGMDVWGQGTTVTVSS

SEQ ID NO: 372 - protein, 121 aa, Artificial Sequence
  Description of Artificial Sequence: Synthetic polypeptide
QVQLQESGPGLVKPSETLSLTCTVSGGSISTYYWSWIRQPPGTGLEWIGYIFYNGNANYSPSLKSRVTFSVDTSKNQFSLKLSSVTAADTAVYFCARETDYGDYARPFEYWGQGTLVTVSS

SEQ ID NO: 373 - protein, 120 aa, Artificial Sequence
  Description of Artificial Sequence: Synthetic polypeptide
QVQLVESGGGVVQPGRSLRLSCAASGFTFSTYGMHWVRQAPGKGLEWVAVIWYDGSNKYYADSVKGRFTISRDNSKNTLYLQMNSLRAEDTAVYYCARGHYDSSGPRDYWGQGTLVTVSS

SEQ ID NO: 374 - protein, 122 aa, Artificial Sequence
  Description of Artificial Sequence: Synthetic polypeptide
QVQLVESGGGVVQPGRSLRLSCAASGFTFSSYGMHWVRQAPGQGLEWVALISYDGSNKYYADSVKGRFTISRDKSKNTLYLQMNSLRAEDTAVYYCAREANWGYNYYGMDVWGQGTTVTVSS

SEQ ID NO: 375 - protein, 122 aa, Artificial Sequence
  Description of Artificial Sequence: Synthetic polypeptide
QVQLQQWGAGLLKPSETLSLTCAVYGGSFSDYYWNWIRQPPGKGPEWIGEINHSGTTNYNPSLKSRVTISVDTSKNQFSLKLSSVTAADTAVYYCVGILRYFDWLEYYFDYWGQGTLVTVSS

SEQ ID NO: 376 - protein, 119 aa, Artificial Sequence
  Description of Artificial Sequence: Synthetic polypeptide
QVQLVQSGAEVKKPGASVKVSCKASGYTFTSYDINWVRQATGQGLEWMGWMNPHSGNTGYAQKFQGRVTMTRNTSINTAYMELSSLRSEDTAVYYCAKYNWNYGAFDFWGQGTMVTVSS

SEQ ID NO: 377 - protein, 119 aa, Artificial Sequence
  Description of Artificial Sequence: Synthetic polypeptide
EVQLLESGGGLVQPGGSLRLSCAASGFTFSSYAMSWVRQAPGKGLEWVSAISGSGRTTYSADSVKGRFTISRDNSKNTLYLQMNSLRAEDTAVYYCAKEQQWLVYFDYWGQGTLVTVSS

SEQ ID NO: 378 - protein, 127 aa, Artificial Sequence
  Description of Artificial Sequence: Synthetic polypeptide
QVQLQESGPGLVKPSQTLSLTCTVSGGSITSGVYYWNWIRQHPGKGLEWIGYLYYSGSTYYNPSLKSRLTISADMSKNQFSLKLSSVTVADTAVYYCARDGITMVRGVTHYYGMDVWGQGTTVTVSS

SEQ ID NO: 379 - protein, 117 aa, Artificial Sequence
  Description of Artificial Sequence: Synthetic polypeptide
QVQLQQWGAGLLKPSETLSLTCAVYGGSFSGYYWSWIRQPPGKGLEWIGEINHSENTNYNPSLKSRVTISLDTSNDQFSLRLTSVTAADTAVYYCARVTGTDAFDFWGQGTMVTVSS

SEQ ID NO: 380 - protein, 123 aa, Artificial Sequence
  Description of Artificial Sequence: Synthetic polypeptide
QVQLVESGGGVVQPGRSLRLSCAASGFTFSSFGMHWVRQAPGKGLEWVALIWYDGDNKYYADSVKGRFTISRDNSKNTLYLQMNSLRAEDTAVYYCARNSGWDYFYYYGMDVWGQGTTVTVSS

SEQ ID NO: 381 - protein, 116 aa, Artificial Sequence
  Description of Artificial Sequence: Synthetic polypeptide
QVQLQESGPGLVKPSETLSLTCTVSGGSISSYYWSWIRQPAGKGLEWIGRIYISGSTNYNPSLENRVTMSGDTSKNQFSLKLNSVTAADTAVYYCAGSGSYSFDYWGQGTLVTVSS

SEQ ID NO: 382 - protein, 129 aa, Artificial Sequence
  Description of Artificial Sequence: Synthetic polypeptide
QVQLVESGGGVVQPGRSLRLSCAASGFTFSSYGLHWVRQAPGKGLEWVAVIWNDGSNKLYADSVKGRFTISRDNSKNTLYLQMNSLRAEDTAVYYCARDQYYDFWSGYPYYHYYGMDVWGQGTTVTVSS

SEQ ID NO: 383 - protein, 122 aa, Artificial Sequence
  Description of Artificial Sequence: Synthetic polypeptide
EVQLVESGGGLVKPGGSLRLSCAASGFTFSSYSMNWVRQAPGKGLEWVSSISSSSTYIYYADSVKGRFTISRDNAKNSLYLQMNSLRAEDTAVYYCARDIYSSGWSYGMDVWGQGTTVTVSS

SEQ ID NO: 384 - protein, 122 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSYQFYADSVKGRFTISRDNSKNTLYLQMNSLRAEDTAVYYCARDHVWRTYRYIFDYWGQGTLVTVSS

SEQ ID NO: 385 - protein, 117 aa, Artificial Sequence
  Description of Artificial Sequence: Synthetic polypeptide
EVQLVQSGPEVKKPGESLKISCKGSGYSLTSYWIGWVRQMPGKGLEWMGIIYPGDSDTRYSPSFQGQVTISADTSISTAYLQWSRLKASDTAVYYCARAQLGIFDYWGQGTLVTVSS

SEQ ID NO: 386 - protein, 117 aa, Artificial Sequence
  Description of Artificial Sequence: Synthetic polypeptide
QVQLQQWGAGLLKPSETLSLTCAVYGGSFSGYYWSWIRQPPGKGLEWIGEINHSENTNYNPSLKSRVTISLDTSNKQFSLRLTSVTAADTAVYYCARVTGTDAFDFWGQGTMVTVSS

SEQ ID NO: 387 - protein, 120 aa, Artificial Sequence
  Description of Artificial Sequence: Synthetic polypeptide
QLQLQESGPGLVKPSETLSLTCTVSGDSISSSSYYWGWIRQPPGKGLEWIGMIYYSGTTYYNPSLKSRVTISVDTSKNQFSLKLSSVTAADTAVYYCARVAAVYWYFDLWGRGTLVTVSS

SEQ ID NO: 388 - protein, 127 aa, Artificial Sequence
  Description of Artificial Sequence: Synthetic polypeptide
QVQLQESGPGLVKPSQTLSLTCTVSGGSITSGVYYWSWIRQLPGKGLEWIGYIYYSGSTYYNPSLKSRLTISADTSKNQFSLKLSSVTVADTAVYYCARDGITMVRGVTHYYGMDVWGQGTTVTVSS

SEQ ID NO: 389 - protein, 123 aa, Artificial Sequence
  Description of Artificial Sequence: Synthetic polypeptide
QVQLQQSGPGLVKPSQTLSLTCAISGDSVSSNSATWNWIRQSPSRGLEWLGRTYYRSKWYNDYAVSVKSRITINPDTSKNQFSLQLNSVTPEDTAVYYCVGIVVVPAVLFDYWGQGTLVTVSS

SEQ ID NO: 390 - protein, 129 aa, Artificial Sequence
  Description of Artificial Sequence: Synthetic polypeptide
QVQLVESGGGVVQPGRSLRLSCAASGFTFSNYGMHWVRQAPGKGLEWVAVIWNDGNNKYYADSVKGRFTISRDNSKNTLYLQMNSLRAEDTAVYYCARDQNYDFWNGYPYYFYYGMDVWGQGTTVTVSS

SEQ ID NO: 391 - protein, 122 aa, Artificial Sequence
  Description of Artificial Sequence: Synthetic polypeptide
QVQVVESGGGLVKPGGSLRLSCAASGFTFSDSYMSWIRQAPGKGLEWISSISSSGSIVYFADSVKGRFTISRDIAKNSLYLHMNSLRAEDTAVYYCARETFSSGWFDAFDIWGQGTMVTVSS

SEQ ID NO: 392 - protein, 122 aa, Artificial Sequence
  Description of Artificial Sequence: Synthetic polypeptide
EVQLVESGGGLVKPGGSLRLSCAASGFTFSSYSMSWVRQAPGKGLEWVSSISSSSTYIYYADSLKGRFTISRDNAKNSLFLQVNSLRAEDSAVYYCARDRWSSGWNEGFDYWGQGTLVTVSS

SEQ ID NO: 393 - protein, 117 aa, Artificial Sequence
  Description of Artificial Sequence: Synthetic polypeptide
QVQLVESGGGVVQPGRSLRLSCAASGFTFSNYGMHWVRQAPGKGLEWVAITSYGGSNKNYADSVKGRFTISRDNSKNTLYLQMNSLRAEDTAVYYCAREAGYSFDYWGQGTLVTVSS

SEQ ID NO: 394 - protein, 121 aa, Artificial Sequence
  Description of Artificial Sequence: Synthetic polypeptide
EVQLLGSGGGLVQPGGSLRLSCAASGFTFNHYAMSWVRQAPGKGLEWVSAISGSGAGTFYADSMKGRFTISRDNSENTLHLQMNSLRAEDTAIYYCAKDLRIAVAGSFDYWGQGTLVTVSS

SEQ ID NO: 395 - protein, 129 aa, Artificial Sequence
  Description of Artificial Sequence: Synthetic polypeptide
QVQLVESGGGVVQPGRSLRLSCAASGFNFSSYGMHWVRQAPGKGLEWVAVIWYDGSNKYYADSVKGRFTISRDNSKNTLYLQMNSLRAEDTAVFYCARDQYFDFWSGYPFFYYYGMDVWGQGTTVTVSS

SEQ ID NO: 396 - protein, 122 aa, Artificial Sequence
  Description of Artificial Sequence: Synthetic polypeptide
EVQLLESGGGLVQPGGSLRLSCAASGFTFSSYAMSWVRQAPGKGLEWVSVISDSGGSTYYADSVKGRFTISRDNSKNTLYLQMNSLRAEDTAVYYCAKDHSSGWYYYGMDVWGQGTTVTVSS

SEQ ID NO: 397 - protein, 125 aa, Artificial Sequence
  Description of Artificial Sequence: Synthetic polypeptide
QVQLVQSGAEVKTPGASVRVSCKASGYTFTNYGISWVRQAPGQGLEWMGWISAYNGYSNYAQKFQDRVTMTTDTSTSTAYMELRSLRSDDTAVYYCAREEKQLVKDYYYYGMDVWGQGSTVTVSS

SEQ ID NO: 398 - protein, 122 aa, Artificial Sequence
  Description of Artificial Sequence: Synthetic polypeptide
EVQLLESGGGLVQPGGSLRLSCAASGFTFSSYAMSWVRQSPGKGLEWVSVISGSGGDTYYADSVKGRFTISRDNSKNTLYLQMNSLRAEDTAVYYCAKDHTSGWYYYGMDVWGQGTTVTVSS

SEQ ID NO: 399 - protein, 115 aa, Artificial Sequence
  Description of Artificial Sequence: Synthetic polypeptide
QVQLQESGPGLVKPSETLSLTCTVSDGSISSYYWNWIRQPAGKGLEWIGRIYTSGSTNYNPSLKSRVTMSVDTSKNQFSLNLTSVTAADTAVYYCARGPLWFDYWGQGTLVTVSS

SEQ ID NO: 400 - protein, 125 aa, Artificial Sequence
  Description of Artificial Sequence: Synthetic polypeptide
QVQLVQSGAEVKKPGASVKVSCKVSGYTLTELSIHWVRQAPGKGLEWMGGFDPEDGETIYAQKFQGRVTMTEDTSTDTAYMELSSLRSEDTAVYYCATHSGSGRFYYYYYGMDVWGQGTTVTVSS

SEQ ID NO: 401 - protein, 120 aa, Artificial Sequence
  Description of Artificial Sequence: Synthetic polypeptide
QLQLQESGPGLVKPSETLSLTCTVSGGSISSSSYYWGWIRQPPGKGLEWIGSIYYSGTTYYNPSLKSRVTISVDTSKNQFSLKLSSVTAADTAVYYCARVAAVYWYFDLWGRGTLVTVSS

SEQ ID NO: 402 - protein, 122 aa, Artificial Sequence
  Description of Artificial Sequence: Synthetic polypeptide
QVQLVQSGAEVKKTGASVKVSCKASGYTFTSHDINWVRQATGHGLEWMGWMNPYSGSTGLAQRFQDRVTMTRNTSISTAYMELSSLRSEDTAVYYCARDLSSGYYYYGLDVWGQGTTVTVSS

SEQ ID NO: 403 - protein, 124 aa, Artificial Sequence
  Description of Artificial Sequence: Synthetic polypeptide
QVQLVQSGAEVKKPGASVKVSCKASGYPFIGYYMHWVRQAPGQGLEWMGWINPDSGGTNYAQKFQGRVTMTRDTSITTAYMELSRLRSDDTAVFYCARGGYSYGYEDYYGMDVWGQGTTVTVSS

SEQ ID NO: 404 - protein, 117 aa, Artificial Sequence
  Description of Artificial Sequence: Synthetic polypeptide
QVQLQQWGAGLLKPSETLSLTCAVYGGSFSGYYWSWIRQPPGKGLEWIGEINHSENTNYNPSLKSRVTISLDTSHDQFSLRLTSVTAADTAVYYCARVTGTDAFDFWGQGTMVTVSS

SEQ ID NO: 405 - protein, 117 aa, Artificial Sequence
  Description of Artificial Sequence: Synthetic polypeptide
QVQLQESGPGLVKPSQTLSLTCTVSNGSINSGNYYWSWIRQHPGKGLEWIGYIYHSGSAYYNPSLKSRVTISVDTSKNQFSLKLSSVTAADTAVYYCARTTGASDIWGQGIMVTVSS

SEQ ID NO: 406 - protein, 108 aa, Artificial Sequence; identical to SEQ ID NO: 312
  Description of Artificial Sequence: Synthetic polypeptide

SEQ ID NO: 407 - protein, 116 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLRLSSVTAADTAVYYCARGITGTIDFWGQGTLVTVSS

SEQ ID NO: 408 - protein, 125 aa, Artificial Sequence
  Description of Artificial Sequence: Synthetic polypeptide
EVQLVESGGGLVQPGGSLRLSCAASGFTFSSYSMNWVRQAPGKGLEWISYISSGSSTIYHADSVKGRFTISRDNAKNSLYLQMNSLRDEDTAVYYCAREGYYDSSGYYYNGMDVWGQGTTVTVSS

SEQ ID NO: 409 - protein, 122 aa, Artificial Sequence
  Description of Artificial Sequence: Synthetic polypeptide
QVQLQQSGPGLVKPSQTLSLTCAISGDSVSSNSAAWNWIRQSPSRGLEWLGRTYYRSKWYNDYAVSVKSRITITPDTSKNQFSLQLKSVTPEDTAIYYCAREGSWSSFFDYWGQGTLVTVSS

SEQ ID NO: 410 - DNA, 324 bp, Artificial Sequence
  Description of Artificial Sequence: Synthetic polynucleotide
gacatccagatgacccagtctccatcctccctgtctgcatctgtaggagacagagtcaccatcacttgccggacaagtcagagtattagcagctatttaaattggtatcagcagaaaccagggaaagcccctaacctcctgatctatgctgcatccagtttgcaaagtggggtcccatcaagattcagtggcagtggatctgggacagatttcactctcaccatcagcggtctgcaacctgaagatttttcaacttactactgtcaacagagttacagtacctcgctcactttcggcggagggaccaaggtggagatcaaacga

SEQ ID NO: 411 - DNA, 324 bp, Artificial Sequence
  Description of Artificial Sequence: Synthetic polynucleotide
gacatccagatgacccagtcgccatcctccctgtctgcatctgtaggagacaggatcaccatcacttgccgggcaagtcagatcattagcaggtatttaaattggtatcagcagaacccagggaaagcccctaagctcctgatctctgctgcatccagtttgcaaagtggagtcccatcaaggttcagtggcagtggatctgggccagatttcactctcaccatcagcagtctgcaacctgaagattttacaacttactactgtcaacagagttacagttccccgctcactttcggcggagggaccaaggtggaggtcaaacga

SEQ ID NO: 412 - DNA, 324 bp, Artificial Sequence
  Description of Artificial Sequence: Synthetic polynucleotide
gacatccagatgacccagtctccatcttccgtgtcttcatctgtaggagacagagtcaccatcacttgtcgggcgagtcagggtattagcaggtggttagcctggtatcagcagaaaccagggaaagcccctaagctcctgatctatgctgcatccagtttgaaaagtggggtcccatcaaggttcagcggcagtggatctgggacagatttcactctcaccatcagcagcctgcagcctgaagattttgcaacttactattgtcaacaggctaacagtttccctccgacgttcggccaagggaccaaggtggaaatcaaacga

SEQ ID NO: 413 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagaacattaacaactatttaaattggtatcggcagaaaccagggaaagcccctgaactcctgatctatactacatccagtttgcaaagtggggtcccatcaaggttcagtggcagtggatctgggacagatttcactctcaccatcagcagtctggaaactgaagattttgaaacttactactgtcaacagagttacagtacccctctcactttcggcggagggaccaaggtggagatcaaacga

SEQ ID NO: 414 - DNA, 327 bp, Artificial Sequence
  Description of Artificial Sequence: Synthetic polynucleotide
tcctatgtgctgactcagccaccctcggtgtcagtggccccaggacagacggccaggattacctgtgggggaaacaacattggaagtaaaagtgtgcagtggtaccagcagaagccaggccaggcccctgtgctggtcgtctacgatgatagcgaccggccctcagggatccctgagcgattctctggctccaactctgggaacacggcctccctgaccatcagcagggtcgaagccggggatgaggccgactattactgtcaggtgtgggatagtagtagtgatcatgtggtattcggcggagggaccaagctgaccgtcctaggt

SEQ ID NO: 415 - DNA, 327 bp, Artificial Sequence
  Description of Artificial Sequence: Synthetic polynucleotide
tcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatcatgtggtattcggcggagggaccaagctgaccgtcctaggt

SEQ ID NO: 416 - DNA, 324 bp, Artificial Sequence
  Description of Artificial Sequence: Synthetic polynucleotide
tcctatgagctgactcagccacactcagtgtcagtggccacagcacagatggccaggatcacctgtgggggaaacaacattggaagtaaagctgtgcactggtaccagcaaaagccaggccaggaccctgtgctggtcatctattgcgatagcaaccggccctcagggatccctgagcgattctctggctccaacccagggaacaccgccaccctaaccatcagcaggatcgaggctggggatgaggctgactattactgtcaggtgtgggacagtagtagtgatggggtattcggcggagggaccaagctgaccgtcctaggt

SEQ ID NO: 417 - DNA, 324 bp, Artificial Sequence
  Description of Artificial Sequence: Synthetic polynucleotide
tcctatgagctgactcagccacactcagtgtcagtggccacagcacagatggccaggatcacctgtgggggaaacaacattggaagtaaaactgtgcactggttccagcaaaagccaggccaggaccctgtgctggtcatctatagcgatagcaaccggccctcagggatccctgagcgattctctggctccaacccagggaacaccgccaccctaaccatcagcaggatcgaggctggggatgaggctgactattactgtcaggtgtgggacagtagttgtgatggggtattcggcggagggaccaagctgaccgtcctaggt

SEQ ID NO: 418 - DNA, 324 bp, Artificial Sequence
  Description of Artificial Sequence: Synthetic polynucleotide
tcctatgagctgactcagccacactcagtgtcagtggccacagcacagatggccaggatcacctgtgggggaaacaacattggaagtaaagctgtgcactggtaccagcaaaagccaggccaggaccctgtgctggtcatctatagcgatagcaaccggccctcagggatccctgagcgattctctggctccaacccagggaacaccgccaccctaaccatcagcaggatcgaggctggggatgaggctgactattactgtcaggtgtgggacagtagtagtgatggggtattcggcggagggaccaagctgaccgtcctaggt

SEQ ID NO: 419 - DNA, 321 bp, Artificial Sequence
  Description of Artificial Sequence: Synthetic polynucleotide
tcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagataacgagcggccctcagggatccctgagcgattctctggctccaactctgggaacacagccactctgaccatcagcgggacccaggctatggatgaggctgactattactgtcaggcgtgggacagcaccactgtggtattcggcggagggaccaagctgaccgtcctaggt

SEQ ID NO: 420 - DNA, 342 bp, Artificial Sequence
  Description of Artificial Sequence: Synthetic polynucleotide
gatgttgtgatgactcagtctccgctctccctgcccgtcacccttggacagccggcctccatctcccgcaggtctagtccaagcctcgtatacagtgatggaaacacctacttgaattgctttcagcagaggccaggccactctccaaggcgcctaatttataagggttctaactgggactcaggggtcccagacagattcagcggcagtgggtcaggcactgatttcactctgaaaatcagcagggtggaggctgaggatgttggtatttattactgcatacaagatacacactggcccacgtgcagttttggccaggggaccaagctggagatcaaacga

SEQ ID NO: 421 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagaaatgatttaggctggtatcagcagaaaccagggaaagcccctaagcgcctgatctatgctgcatccaatttgcaaaggggggtcccatcaaggttcagcggcagtggatctgggacagaattcactctcacaatcagcaccctgcagcctgaagattttgcaacttattcctgtctccagcataatagttaccctctcactttcggcggagggaccaaggtggagatcaaacga

SEQ ID NO: 422 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccaatttgcaaagtggggtcccatcaaggttcagcggcagtggatctgggacaaaattcactctcacaatcaacagcctgcagcctgaagattttgcaacttattactgtctacaacttaatggttaccctctcactttcggcggagggaccaaggtggagatcaaacga

SEQ ID NO: 423 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagaaatgatttaggctggtatcaacagaaaccagggaaagcccctaagcgcctgatctatgctgcatccaatttgcaaaggggggtcccatcaaggttcagcggcagtggatctgggacagaattcactctcacaatcagcaccctgcagcctgacgattttgcaacttattcctgtctccagcataatagttaccctctcactttcggcggagggaccaaggtggagatcaaacga

SEQ ID NO: 424 - DNA, 315 bp, Artificial Sequence
  Description of Artificial Sequence: Synthetic polynucleotide
tcctatgacctgactcagccaccctcagtgtccgtgtccccaggacagacagccagcatcacctgctctggagataaattgggggataaatatgtttgctggtatcagcagaagccaggccagtcccctgtgctggtcatctatcaagatagtaagcggccctcagggatccctgagcgattctctggctccaactctgggaacacagccactctgaccatcagcgggatccaggctatggatgaggctgactattactgtcaggcgtgggacagcagggtattcggcggagggaccaagctgaccgtcctaggt

SEQ ID NO: 425 - DNA, 321 bp, Artificial Sequence
  Description of Artificial Sequence: Synthetic polynucleotide
tcctatgagatgactcagccactctcagtgtcagtggccctgggacagacggccaggattacctgtgggggaaacaacattggaagtaaaaatgtacactggtaccagcagaagccaggccaggcccctgtgttggtcatctatagggatagcaagcggccctctgggatccctgagcgattctctggctccaactcggggaacacggccaccctgaccatcagcagagcccaagccggggatgaggctgactattactgtcaggtgtgggacagcagtagtgtggtattcggcggagggaccaagctgaccgtcctaggt

SEQ ID NO: 426 - DNA, 321 bp, Artificial Sequence
  Description of Artificial Sequence: Synthetic polynucleotide
tcctatgagctgactcagccactctcagtgtctgtggccctgggccagacggccaggattccctgtgggggaaatgacattggaagtaaaaatgtgcactggtaccagcagaaaccaggccaggcccctgtgctggtcatctatagggatcgcaaccggccctctgggatccctgagcgattctctggctccaactcggggaacacggccaccctgaccatcagcagagcccaagccggggatgaggctgactattactgtcaggtgtgggacagcaaccctgtggtattcggcggagggaccaagctgaccgtcctaggt

SEQ ID NO: 427 - DNA, 321 bp, Artificial Sequence
  Description of Artificial Sequence: Synthetic polynucleotide
tcctatgagctgactcagccactctcagtgtcagtggccctgggacagacggccaggattacctgtgggggaaacaacattggaagtaaaaatgtgcactggtaccagcagaagccaggccaggcccctgtgctggtcatctatagggatagaaaccggccctctgggatccctgagcgattctctggctccaactcggggaacacggccaccctgaccatcagcagagcccaagccggggatgaggctgactattactgtcaggtgtgggacagcagcactgtggtcttcggcggagggaccaagctgaccgtcctaggt

SEQ ID NO: 428 - DNA, 321 bp, Artificial Sequence
  Description of Artificial Sequence: Synthetic polynucleotide
tcctatgagctgactcagccactctcagtgtcagtggccctgggacagacggccaggcttacctgtgggggtaacaacattggaagtataaatgtgcactggtaccagcagaagccaggccaggcccctgtgttggtcatctatagggataggaaccggccctctgggatccctgagcgattctctggctccaactcgggtaacacggccaccctgaccatcagcagagcccaagccggggatgaggctgactattactgtcagttgtgggacagcagcactgtggttttcggcggagggaccaagctgaccgtcctaggt

SEQ ID NO: 429 - DNA, 321 bp, Artificial Sequence
  Description of Artificial Sequence: Synthetic polynucleotide
tcctatgagctgactcagccactctcagtgtcagtggccctgggacagacggccaggattacctgtgggggaaacaacattggaagttacaatgtgttctggtaccagcagaagccaggccaggcccctgtgctggtcatctatagggatagcaagcggccctctgggatccctgagcgattctctggctccaactcggggaacacggccaccctgaccatcagcagagcccaagccggggatgaggctgactatcactgtcaggtgtgggacagcagcactgtggtattcggcggagggaccaagctgaccgtcctaggt

SEQ ID NO: 430 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttagcagcatctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcgtgcagttttggccaggggaccaagctggagatcaaacga

SEQ ID NO: 431 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttagtaacagctacttagcctggtaccagcagaaacctggccaggctcccaggctcctcatctatggtgcattcagtagggccactggcatcccagacaggttcagtggcagtgggtctgggacagacttcactctcaccatcagcagactggagcctgaagattttgcagtatattactgtcagcagtttggtaggtcattcactttcggcggagggaccaaggtggagatcagacga

SEQ ID NO: 432 - DNA, 324 bp, Artificial Sequence
  Description of Artificial Sequence: Synthetic polynucleotide
gaagttgtgttgacgcagtctccaggcaccctgtctttgtctccaggggaaagagccaccctctcctgcagggccagtcagactgttaggaacaactacttagcctggtaccagcagcaacctggccaggctcccaggctcctcatctttggtgcgtccagcagggccactggcatcccagacaggttcagtggcagtgggtctgggacagacttcactctcaccatcagcagactggagcctgaagattttgcagtgtattactgtcagcagtttggtagttcactcactttcggcggagggaccaaggtggagatcaaacga

SEQ ID NO: 433 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttaggaacagctacttagcctggtaccagcagcaacctggccaggctcccaggctcctcatctatggtgcatttagcagggcctctggcatcccagacaggttcagtggcagtgggtctgggacagacttcactctcaccatcagcagactggagcctgaagattttgcagtgtattactgtcagcagtttggaagctcactcactttcggcggagggaccaaggtggagatcaaacga

SEQ ID NO: 434 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagactattaggaacagctacttagcctggtaccagcagcaacctggccaggctcccaggctcctcatctatggtgcattcagcagggccactggcatcccagacaggttcagtggcggtgggtctgggacagacttcactctcaccatcagcagactggagcctgaagattttgcagtgtattactgtcagcagtttggtagctcactcactttcggcggagggaccaaggtggagatcaaacga

SEQ ID NO: 435 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttaggaacagctacttagcctggtaccagcagcaacctggccaggctcccaggctcctcatctatggtgcattcagcagggccactggcatcccagacaggttcagtggcagtgggtctgggacagacttcactctcaccatcagcagactggagcctgaagattttgcagtgtattactgtcagcagtttggtagctcactcactttcggcggagggaccaaggtggagatcaaacga

SEQ ID NO: 436 - DNA, 324 bp, Artificial Sequence
  Description of Artificial Sequence: Synthetic polynucleotide
gaaatactgatgacgcagtctccagccaccctgtctgtgtctccaggggaaagagccaccctctcctgcagggccagtcagagtgttaacagcaacttagcctggtaccagcagaaacctggccaggctcccaggctcctcatctatggtacatccaccagggccactggtgtcccagccaggttcggtggcagtgggtctgggacagaattcactctcaccatcagcagcctgcagtctgaagattttgcattttattactgtcagcaatataatacctggccgtggacgttcggccaagggaccaaggtggaaatcaaacga

SEQ ID NO: 437 - DNA, 324 bp, Artificial Sequence
  Description of Artificial Sequence: Synthetic polynucleotide
gaaatactgatgacgcagtctccagccaccctgtctgtgtctccaggggaaagagccaccctctcctgcagggccagtcagagtgttagcagcaacttagcctggtaccagcagaaacctggccagtctcccaggctcctcatctatggtgcatccaccagggccactggtatcccagccaggttcggtggcagtgggtctgggacagacttcactctcaccatcagcagcctgcagtctgaagattttgcattttattactgtcagcagtataatacctggccgtggacgttcggccaagggaccaaggtggaaatcaaacga

SEQ ID NO: 438 - DNA, 330 bp, Artificial Sequence
  Description of Artificial Sequence: Synthetic polynucleotide
gaaattgtattgacgcagtctccaggcaccctgtctttgtctccaggggaaagagccaccctctcctgcagggccagtcagagtgttagtcgcaactacttagcctggtaccagcagaaacctggccaggctcccaggctcctcatctatggtgcatccagcagggccactggcgtcccagacaggttcagtggcagtgggtctgggacagacttcactctcaccatcagcagactggagcctgaagattttgcagtgtattactgtcagcagtatggtagttcatctctgtgcagttttggccaggggaccaacctggacatcagacga

SEQ ID NO: 439 - DNA, 324 bp, Artificial Sequence
  Description of Artificial Sequence: Synthetic polynucleotide
gaaatggtgatgacgcagtccccagccaccctgtctgtgtctccaggggaaagagccaccctctcctgcagggccagtcagagtgttagcagccagttagcctggtaccaggagaaacctggccgggctcccaggctcctcatctatggtgcctccaacagggccattgatatcccagccaggttaagtggcagtgggtctgggacagagttcactctcaccatcagcagcctgcagtctgaagattttgctgtttattactgtcagcagtataataactggccgtggacgttcggccaagggaccaaggtggaattcaaacga

SEQ ID NO: 440 - DNA, 324 bp, Artificial Sequence
  Description of Artificial Sequence: Synthetic polynucleotide
gaaatagtgatgacgcagtctccagccaccctgtctgtgtctccaggggaaagagtcaccctctcctgcagggccagtcagagtgttagcagcaacttagcctggtaccagcagaaacctggccaggctcccaggctcctcatacatggttcatccaacagggccattggtatcccagccaggttcagtggcagtgggtctgggacagagttcactctcaccatcagcagcctgcagtctgcagattttgctgtttataactgtcagcagtatgaaatttggccgtggacgttcggccaagggaccaaggtggaaatcaaacga

SEQ ID NO: 441 - DNA, 333 bp, Artificial Sequence
  Description of Artificial Sequence: Synthetic polynucleotide
cagtctgtgttgacgcagccgccctcagtgtctgcggccccaggacagaaggtcaccatctcctgctctggaagcagctccaatattgggaataattatgtagcctggtaccagcagctcccaggaacagcccccaaactcctcatttatgacaatgataagcgaccctcagggattcctgaccgattctctggctccaagtctggcacgtcagccaccctgggcatcaccggactccagactggggacgaggccgattattactgcggaacatgggatagcagcctgagtgctgtggtattcggcggagggaccaagctgaccgtcctaggt

SEQ ID NO: 442 - DNA, 333 bp, Artificial Sequence
  Description of Artificial Sequence: Synthetic polynucleotide
cagtctgtgttgacgcagccgccctcagtgtctgcggccccaggacagaaggtcaccatctcctgctctggaagcagttccaacattggaaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgctgtggtattcggcggagggaccaaactgaccgtcctaggt

SEQ ID NO: 443 - DNA, 342 bp, Artificial Sequence
  Description of Artificial Sequence: Synthetic polynucleotide
gatattgtgatgacccagactccactctccctgcccgtcacccctggagagccggcctccatctcctgcaggtctagtcagagcctcttaaatagtgatgatggaaatacctatttggactggtacctgcagaagccagggcagtctccacaactcctgatctatacgctttcctatcgggcctctggagtcccagacaggttcagtggcactgggtcaggcactgaattcacactgaaaatcagcagggtggaggctgaggatgttggagtttattactgcatgcaacgtctagagtttcctattaccttcggccaagggacacgactggagattaaacga

SEQ ID NO: 444 - DNA, 342 bp, Artificial Sequence
  Description of Artificial Sequence: Synthetic polynucleotide
gattttgtgatgacccagactccactctccctgcccgtcacccctggagagccggcctccatctcctgcaggtctagtcagagcctcttaaatagtgatgatggaaacacctatttggactggtacctgcagaagccagggcagtctccacagctcctgatctatacgctttcctatcgggcctctggagtcccagacaggttcagtggcagtgggtcaggcactgatttcacactgaaaatcagcagggtggaggctgaggatgttggagtttattactgcatgcaacgtatagagtttcctatcaccttcggccaagggacacgactggagattaaacga

SEQ ID NO: 445 - DNA, 321 bp, Artificial Sequence
  Description of Artificial Sequence: Synthetic polynucleotide
tcctacgagctgactcagccactctcagtgtcagtggccctgggacagacggccaggattacctgtgggggaaacaacattggaagtaaaaatgtgcactggtaccagcagaagccaggccaggcccctgtggtggtcatctatagggatagcaagcggccctctgggatccctgagcgattctctggctccaactcggggaacacggccaccctgaccatcagcagagcccaagccggggatgaggctgactattactgtcaggtgtgggacagcagtcctgtggtattcggcggagggaccaagctgaccgtcctaggt

SEQ ID NO: 446 - DNA, 324 bp, Artificial Sequence
  Description of Artificial Sequence: Synthetic polynucleotide
gacatccagatgacccagtctccatcctccctgtctgtatctgtaggagacagagtcaccatcacttgccgggcaagtcaggacattagaaatgatttagcctggtatcagcagacaccagggaaagcccctaagcgcctgatctatgcttcatccagtttgcaaagtggggtcccatcaaggttcagcggcactggatctgggacagaattcactctcacaatcagcagcctgcagcctgaagattttgcaacttatttctgtctacagcgtaatagttacccgctcactttcggcggagggaccaaggtggagatcaaacga

SEQ ID NO: 447 - DNA, 342 bp, Artificial Sequence
  Description of Artificial Sequence: Synthetic polynucleotide
gatattgtaatgacccagaccccactctccctgcccgtcatccctggagagccggcctccatcttctgcaggtctagtcagagcctcttaaatagtgatgctggtaccacctatttggactggtacctgcagaagccagggcagtctccacaactcctgatctatacgctttcctttcgggcctctggagtcccagacaggttcagtggcagtgggtcaggcactgatttcacactgaaaatcactagggtggaggctgaggatgttggagtttattattgcatgcaacgtatagagttccctatcaccttcggccaagggacacgactggagattaaacga

SEQ ID NO: 448 - DNA, 324 bp, Artificial Sequence
  Description of Artificial Sequence: Synthetic polynucleotide
gacatccagatgacccagtctccatcctccctgtctgcatctataggagacagagtcaccatcacttgccgggcaagtcagaacattaggacctatttaaattggtatcagcagaaaccagggaaagcccctaagctcctgatttatgttgcatccagtttggaaagtggggtcccatcaaggttcagtggcactggatctgggacagatttcgctctcaccatcagcagtctccaacctgaagattttgcaacttactactgtcaacagagtgacagtatccctcggacgttcggccaagggaccaaggtggaaatcaaacga

SEQ ID NO: 449 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagaggattagcagttatttaaattggtatcagcagaaaccagggaaagcccctaagttcttgatatatgctgtatccagtttgcaaagtggggtcccatcaaggttcagtggcagtggatctgggacagatttcactctcaccatcagcagtctggaacctgaagattttgcaacttactactgtcaacagagttacagtgctacattcactttcggccctgggaccaaagtggatatcaaacga

SEQ ID NO: 450 - DNA, 324 bp, Artificial Sequence
  Description of Artificial Sequence: Synthetic polynucleotide
gaaattgtgctgactcagtctccagactttcagtctgtgactccaaaggagaaagtcaccatcacctgccgggccagtcaggacattggtaatagcttacactggtaccagcagaaaccagatcagtctccaaagctcctcatcaagtttgcttcccagtccttctcaggggtcccctcgaggttcagtggcagtggatctgggacagatttcgccctcaccatcaatagcctggaagctgaagatgctgcaacgtattactgtcatcagagtagtgatttaccgctcactttcggcggagggaccaaggtggacatcaaacga

SEQ ID NO: 451 - DNA, 324 bp, Artificial Sequence
  Description of Artificial Sequence: Synthetic polynucleotide
gacatccagatgacccagtctccatcctctctgtctacatctgtaggagacagagtcaccatcacttgccgggcaagtcagaacattaggagctatttaaattggtatcaactgaaaccagggaaagcccctaaggtcctgatctatggtgcatctaatttacagagtggggtcccatcaaggttcagtggcagtggatctgggacagatttcactctcaccatcagcaatctgcaatctgaagattttgcaatttactactgtcaacagagttacaataccccgtgcagttttggccaggggaccaagctggagatcaaacga

SEQ ID NO: 452 - DNA, 342 bp, Artificial Sequence
  Description of Artificial Sequence: Synthetic polynucleotide
gatattgtgatgacccagactccactctccctgcccgtcacccctggagagccggcctccatctcctgcaggtctagtcagagcctcttggatagtgatgatggaaacacctatttggactggtacctgcagaagccagggcagtctccacagctcctgatctatacgctttcctatcgggcctctggagtcccagacaggttcagtggcagtgggtcaggcactgatttcacactgaaaatcagcagggtggaggctgaggatgttggagtttattactgcatgcaacgtatagagtttccgatcaccttcggccaagggacacgactggagattaaacga

SEQ ID NO: 453 - DNA, 324 bp, Artificial Sequence
  Description of Artificial Sequence: Synthetic polynucleotide
gacatccagatgacccagtctccatcctccctgtctgcatctgtaggagacagagtcaccttcacttgccaggcgagtcaggacattaacatctatttaaattggtatcagcagaaaccagggaaagcccctaagctcctgatctacgatgtatccaatttggaaacaggggtcccatcaaggttcagtggaagtggatctgggacagattttactttcaccatcagcagcctgcagcctgaagatattgcaacatatttctgtcaacaatatgataatctcccattcactttcggccctgggaccaaagtggatctcaaacga

SEQ ID NO: 454 - DNA, 342 bp, Artificial Sequence
  Description of Artificial Sequence: Synthetic polynucleotide
gatattgtgttgacccagactccactctccctgcccgtcacccctggagagccggcctccatctcctgcaggtctagtcagagcctcttggatagtgatgatggagacacctatttggactggtacctgcagaagccagggcagtctccacagctcctgatctatacgctttcctatcgggcctctggagtcccagacaggttcagtggcagtgggtcaggcactgatttcacactgaaaatcagcagggtggaggctgaggatgttggagtttattactgcatgcaacatatagaatttccttcgaccttcggccaagggacacgactggagattaaacga

SEQ ID NO: 455 - DNA, 324 bp, Artificial Sequence
  Description of Artificial Sequence: Synthetic polynucleotide
gacatccagatgacccagtctccatcctccctgtctgcatctataggagacagagtcaccatcacttgccaggcgagtcagggcattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgctacatattactgtcaccagtatgatgatctcccgctcactttcggcggagggaccaaggtggagatcagacga

SEQ ID NO: 456 - DNA, 324 bp, Artificial Sequence
  Description of Artificial Sequence: Synthetic polynucleotide
gacatccagatgacccagtctccatcctccctgtctgcatctgtaggagacagagtcaccatcacttgccaggcgagtcaagacattaccaaatatttaaattggtatcagcagaaaccagggaaagcccctaagctcctgatctacgatacattcattttggaaacaggggtcccatcaaggttcagtggaagtggatctgggacagattttactttcaccatcagcagcctgcagcctgaagatattgcaacatattactgtcaacagtatgacaatttaccgctcaccttcggccaagggacacgactggagattaaacga

SEQ ID NO: 457 - DNA, 336 bp, Artificial Sequence
  Description of Artificial Sequence: Synthetic polynucleotide
aattttatactgactcagccccactctgtgtcggagtctccggggaagacggtaaccatctcctgcacccgcagcagtggcagcattgccagcgactatgtgcagtggtaccagcagcgcccgggcagttcccccaccactgtgatctatgaggataaagaaagatcctctggggtccctgatcggttctctggctccatcgacagttcctccaactctgcctccctcaccatctctggactgaagactgaggacgaggctgactactactgtcagtcttatgatcgcaacaatcatgtggttttcggcggagggaccaagctgaccgtcctaggt

SEQ ID NO: 458 - DNA, 327 bp, Artificial Sequence
  Description of Artificial Sequence: Synthetic polynucleotide
tcctatgagttgacacagccgccctcggtgtctgtgtccccaggccaaacggccaggatcacctgctctggagatgcattgccaaaaaaatatgcttattggtaccagcagaagtcaggccaggcccctgtgctggtcatctatgaggacagcaaacgaccctccgggatccctgagagattctctggctccatctcagggacaatggccaccttgactatcagtggggcccaggtggaggatgaagctgactactactgttactcaacagacagcagtgttaatcatgtggtattcggcggagggaccaagctgaccgtcctaggt

SEQ ID NO: 459 - DNA, 321 bp, Artificial Sequence
  Description of Artificial Sequence: Synthetic polynucleotide
tcctatgacctgactcagccaccctcagtgtccgtgtccccaggacagacagccagcatcacctgctctggagacgaattgggggataaatatgcttgctggtatcagcagaagccaggccagtcccctgtgctggtcatctatcaagataccaagcggccctcagggatccctgagcgattctctggctccaactctgggaacacagccactctgaccatcagcgggacccaggctatggatgaggctgactattactgtcaggcgtgggacagcggcactgtggtattcggcggagggaccaaactgaccgtcctaggt

SEQ ID NO: 460 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagaaatgatttaggctggtatcagcagaaaccagggaaagcccctaaccgcctgatctatgctgcatccagtttgcaatttggggtcccatcaaggttcagcggcagtggatctgggacagaattcactctcacaatcagcagcctgcagcctgaagattttgcaacttattactgtctacaacatagtagttacccgctcactttcggcggagggaccagggtggagatcaaacga

SEQ ID NO: 461 - DNA, 327 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgatgcatccagtttgcaaagtggggtcccatcaaggttcagcggcagtggatctgggacagatttcactctcaccatcagcagcctgcagcctgaagattttgcaacttactattgtcaacagactaacagtttccctccgtggacgttcggccaagggaccaaggtggaaatcaaacga

SEQ ID NO: 462 - DNA, 324 bp, Artificial Sequence
  Description of Artificial Sequence: Synthetic polynucleotide
gacatccagatgacccagtctccatccttcctgtctgcatctgtaggagacagagtcaccatcacttgccgggcaagtcagactattagcagttatttaaattggcatcagcagaaaccagggaaagcccctaagctcctgatctatgctgcatccagtttgcaaagtggggtcccatcaaggttcagtggcagtggatctgggacagatttcagtctcaccatcagcagtctgcaacctgaagattttgcaacttactactgtcagcagagttacagtaccccgctcactttcggcggcgggaccaaggtggagatcaaacga

SEQ ID NO: 463 - DNA, 324 bp, Artificial Sequence
  Description of Artificial Sequence: Synthetic polynucleotide
gaagttgtgctgacgcagtctccagccaccctgtctgtgtctccagggggaagagccaccctctcctgcagggccagtcagagtgttagcgacatcttagcctggtaccaacagaaacctggccaggctcccaggctcctcatctatggtgcatccaccagggccactggtatcccagccaggttcagtggcggtgggtctgggacagagttcactctcaccatcagtagcctgcagtctgaagattttgcagtttatttctgtcagcagtataataactggccgctcactttcggcggagggaccaaggtggagatcaaacga

SEQ ID NO: 464 - DNA, 333 bp, Artificial Sequence
  Description of Artificial Sequence: Synthetic polynucleotide
cagtctgtgttgacgcagccgccctcagtgtctgcggccccaggacagaaggtcaccatctcctgctctggaagcagctccaacattgggattaattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattgctgcggaacatgggatagcagcctgagtgctgtggtattcggcggagggaccaagctgaccgtcctaggt

SEQ ID NO: 465 - DNA, 339 bp, Artificial Sequence
  Description of Artificial Sequence: Synthetic polynucleotide
gatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagggggtcaggcacagatttttcactgaaaatcagcagagtggaggctgaggatgttgggatttattactgcatgcaagctctacaaactccattcactttcggccctgggaccaatgtggatatcaaacaa

SEQ ID NO: 466 - DNA, 327 bp, Artificial Sequence
  Description of Artificial Sequence: Synthetic polynucleotide
gaaaatgtgttgacgcagtctccaggcaccctgtctttgtctccaggggaaagagccaccctctcttgtagggccagtcagagtgttagaagcagctacttagcctggtaccagcagagacctggccaggctcccaggctcctcatctttggtgcatccaggagggccactggcatcccagacaggttcagtggcagtgggtctgggacagacttcactctcaccatcagcagactggagcctgaagattttgcagtgtattactgtcagcagtatggtagttcacctcgcagttttggccaggggaccaagctggagatcaaacga

SEQ ID NO: 467 - DNA, 339 bp, Artificial Sequence
  Description of Artificial Sequence: Synthetic polynucleotide
gatattgtgatgactcagtctccactctccctgcccgtcacccctggagagccggcctccatctcctgcaggtctagtcagagcctccagcatagtaatggatacaactatttggattggtacctgcagaagccaggacagtctccacagttattgatctatttggattctaatcgggcctccggggtccctgacaggttcagtggcagtggatcaggcacagattttacactgaaaatcagcagagtggaggctgaggatattggggtttattactgcatgcaaggtctacaaactcctcccactttcggcggagggaccaaggtggagatcaaacga

SEQ ID NO: 468 - DNA, 324 bp, Artificial Sequence
  Description of Artificial Sequence: Synthetic polynucleotide
gacatccagatgacccagtctccatcttccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagcggatctgggacagaattcactctcacaatcagcagcctgcagcctgaagattttgcaacttattactgtctacagcataagagttacccattcactttcggccctgggaccaaaatggatatcaaagga

SEQ ID NO: 469 - DNA, 321 bp, Artificial Sequence
  Description of Artificial Sequence: Synthetic polynucleotide
gaaatagtgatgacgcagtctccagtcaccttgtctgtgtctccaggggaaagagccatcatctcctgcagggccagtcagagtgttagcagcaacgtcgcctggtaccagcagaaacctggccagactcccaggctcctcatctatggtgcatccaccagggccactggtctcccaaccaggtttagtggcagtgggtctgggacagtgttcactctcaccatcagcagcctgcagcctgaagattttgcagtttattactgtcagcagtttagtaactcaatcaccttcggccaagggacacgactggagattaaacga

SEQ ID NO: 470 - DNA, 324 bp, Artificial Sequence
  Description of Artificial Sequence: Synthetic polynucleotide
gacatccagatggcccagtctccatcctccctgtctgcatctgttggagacagagtcaccatcacttgccaggcgagtcaggacattagcatctatttaaattggtatcagctgaaaccagggaaagcccctaagctcctgatctacgatgtatccaatttggaaacaggggtcccatcaaggttcagtggaggtggatctgggacagattttactttcaccatcagcagcctgcagcctgaagatattgcaacatattactgtcaacagtatgataatctccctctcactttcggccctgggaccaaagtggatatcaaacga

SEQ ID NO: 471 - DNA, 324 bp, Artificial Sequence
  Description of Artificial Sequence: Synthetic polynucleotide
gaaattgtggtgacgcagtctccaggcaccctgtctttgtctgtaggggaaagagccatcctctcctgcagggccagtcagagttttagcagcagttacttagcctggtaccagcagaaacctggccaggctcccaggctcctcatctatggtgcatccagcagggccactggcatcccagacaggttcagcggcagtgggtctgggacagacttcactctcaccatcagtagactggagcctgaagattttgcagtgtattactgtcagcagtatggtagctcacggacgttcggccaagggaccaaggtggaaatcaaacga

SEQ ID NO: 472 - DNA, 324 bp, Artificial Sequence
  Description of Artificial Sequence: Synthetic polynucleotide
gacatccagatgacccagtctccatcctcactgtctgtatctgtaggagacagagtcaccatcacttgtcgggcgagtcaggacattagcaattatttagcctggtttcagcagaaaccagggaaagcccctaagtccctgatctatgctgcatccagtttgcaaagtggggtcccatcaaagttcagcggcagtggatctgggacagatttcactctcaccatcagcagcctgcagcctgaagattttgcaacttattactgccaacagtataatatttaccctcggacgttcggccaagggaccaaggtggaaatcaagcga

SEQ ID NO: 473 - DNA, 324 bp, Artificial Sequence
  Description of Artificial Sequence: Synthetic polynucleotide
gacatccagatgacccagtctccatcctccctgtctacatctataggagacagaatcaccatcacttgccgggcaagtcagagcattagtaactatttaaattggtttcagcagatcccagggaaagcccctaggctcctgatctatacagcttccagtttgcaaagtggggtcccatcgaggttcagtggcagtggatctgggacagatttcactctcaccatcagcagtctgcaacctgaagattttgcaacttactactgtcaacagagttccagtatcccttggacgttcggccaagggaccaaggtggaaatcaaacga

SEQ ID NO: 474 - DNA, 339 bp, Artificial Sequence
  Description of Artificial Sequence: Synthetic polynucleotide
gatattgtgatgactcagtctccactctccctgcccgtcacccctggagagccggcctccatctcctgcaggtctagtcagagcctcctgcatagtaacggattcaactatttggattggtacctgcagaagccagggcagtctccacaggtcctgatctatttgggttctaatcgggcctccggggtccctgacaggttcagtggcagtggatcaggcacagattttacactgaaaatcagcagagtggaggctgaggatgttgggatttattactgcatgcaagctctacaaactctcatcaccttcggccaagggacacgactggagattaaacga

SEQ ID NO: 475 - DNA, 321 bp, Artificial Sequence
  Description of Artificial Sequence: Synthetic polynucleotide
tcctatgaactgactcagccaccctcagtgtccgtgtccccaggacagacagccagcatcacctgctctggagataatttgggggataaatatgctttctggtatcaacagaagccaggccagtcccctgtattggtcatctatcaagataacaagcggccctcagggatccctgagcgattctctggctccaactctgggaacacagccactctgaccatcagcgggacccaggctgtggatgaggctgactattactgtcaggcgtgggacagcgccactgtgattttcggcggagggaccaagttgaccgtcctaggt

SEQ ID NO: 476 - DNA, 327 bp, Artificial Sequence
  Description of Artificial Sequence: Synthetic polynucleotide
gacatccaaatgacccagtctccatcttccgtgtctgcatctgtaggagacagagtcaccatcacttgtcgggcgagtcaggatattagcagttggttagcctggtatcagcagaaaccagggaaagcccctaaattcctgatctatgatgcatccactttgcaaagtggggtcccatcaaggttcagcggcagtggatctggggcagatttcactctcaccatcaacaacctgcagcctgaagattttgcaacttactattgtcaacagactaacagttttcctccgtggacgttcggccaagggaccaaggtggaaatcaaacga

SEQ ID NO: 477 - DNA, 324 bp, Artificial Sequence
  Description of Artificial Sequence: Synthetic polynucleotide
tcctatgtgctgactcagccaccctcggtgtcagtggccccaggacaggcggccaggattacctgtgggggaaacgacattggaagtaaaagtgtgcactggtaccagcagaagccaggccaggcccctgtgctggtcgtctatgatgatagcgaccggccctcagggatccctgagcgattctctggctccaagtctgggaacacggccaccctgattatcagcagggtcgaagccggggaagaggccgactattattgtcaggtgtgggatagtagtagtgatgtggtattcggcggagggaccaagttgaccgtcctaggt

SEQ ID NO: 478 - DNA, 324 bp, Artificial Sequence
  Description of Artificial Sequence: Synthetic polynucleotide
gacctccagatgacccagtctccttcctccctgtctgcatctgtaggagacagagtcaccatcacttgccaggcgagtcaggacattaaaaaatttttaaattggtatcagcagaaaccaggtaaagcccctaacctcctgatctacgatgcatccaatttggaaacaggggtcccatcaaggttcagtggaagtggatctgggacagattttactttcaccatcagcagcctgcagcctgaagatattgcaacatattactgtcaacaatatgctattctcccattcactttcggccctgggaccacagtggatatcaaacga

SEQ ID NO: 479 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattagcaactatttaaattggtttctgcagataccagggaaagcccctaaactcctgatctatgcagcttccagtttacaaagtggggtcccatcgaggttcagtggcagtggatctgggacagatttcactctcaccatcaacagtctgcaacctgaagattttggaacttactactgccaacagagttccactatcccttggacgttcggccaagggaccaaggtggaaatcaaacga

SEQ ID NO: 480 - DNA, 327 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttagcagagactacttagcctggtatcggcagaaacctggccaggctcccaggctcctcgtctatggtgcatccgccagggccactggcatcccagacagattcagtggcagtgggtctgggacagacttcactctcaccatcagcagactggagcctgaagattttgcagtgtattactgtcagcaatatggtagatcactattcactttcggccctgggaccaaagtggatatcaaacga

SEQ ID NO: 481 - DNA, 324 bp, Artificial Sequence
  Description of Artificial Sequence: Synthetic polynucleotide
gacatccagatgacccagtctccatcctcactgtctgtatctgtaggagacagagtcaccatcacttgtcgggcgagtcatgacattagcaattatttagcctggtttcagcagaaaccagggaaagcccctaagtccctgatctatgctgcatccagtttgcaaagtggggtcccatcaaagttcagcggcagtggatctgggacagatttcactctcaccatcagcagcctgcagcctgaagattttgcaacttattactgccaacaatataatacttaccctcggacgttcggccaagggaccaaggtggaaatcaagcga

SEQ ID NO: 482 - DNA, 327 bp, Artificial Sequence
  Description of Artificial Sequence: Synthetic polynucleotide
gaaattgtgttgacgcagtctccaggcaccctgtctttgtctccaggggaaagagccaccctctcctgcagggccagtccgagtgttagcagcagctacttagcctggtaccagcagaaacctgcccaggctcccaggctcctcatctatggtgcatccagtagggccactggcatcccagacaggttcagtggcagtgggtctgggacagacttcactctcaccatcagcagactggagcctgaagattttgcagtgtattactgtcatcagtatggtacctcaccgtgcagttttggccaggggaccaagctggagatcaaacga

SEQ ID NO: 483 - DNA, 327 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcagctggttagcctggtatcagcagaaaccagggaaagcccctaaactcctgatctatggtgcatccagtttgcaaagtggggtcccatcaaggttcagcggcagtggatctgggacagatttcactctcaccatcagcagcctgcagcctgaagattttgcaacttattattgtcaacagactaacagtttccctccgtggacgttcggccaagggaccaaggtggaaatcaaacga

SEQ ID NO: 484 - DNA, 327 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcaggatattgacagctggttagtctggtatcagcagaaaccagggaaagcccctaacctcctgatctatgctgcatccaatttgcaaagaggggtcccatcaaggttcagcggcagtggatctgggacagatttcactctcaccatcgccagcctgcagcctgaagattttgcaacttactattgtcagcagactaacagtttccctccgtggacgttcggccaagggaccaaggtggaaatcaaacga

SEQ ID NO: 485 - DNA, 324 bp, Artificial Sequence
  Description of Artificial Sequence: Synthetic polynucleotide
tcctatgagctgtctcagccaccctcagtgtccgtgtccccaggacagacagtcagcatcacctgctctggagataatttgggggataaatatgcttgctggtatcagcagaggccaggccagtcccctgtcctggtcatctatcaagataccaagcggccctcagggatccctgagcgattctctggctccaattctgggaacacagccactctgaccatcagcgggacccaggctatggatgaggctgactattactgtcaggcgtgggacagcagcactacatgggtgttcggcggagggaccaagctgaccgtcctaggt

SEQ ID NO: 486 - DNA, 333 bp, Artificial Sequence
  Description of Artificial Sequence: Synthetic polynucleotide
cagtctgtgttgacgcagccgccctcagtgtctgcggccccaggacagaaggtcaccatctcctgctctggaagcagctccaacattggggataattatgtatcctggtaccagcagttcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggacagcagcctgagtgttatggttttcggcggagggaccaagctgaccgtcctaggt

SEQ ID NO: 487 - DNA, 342 bp, Artificial Sequence
  Description of Artificial Sequence: Synthetic polynucleotide
gatattgtgctgacccagactccactctccctgcccgtcacccctggagagccggcctccatctcctgcaggtctagtcagagcctcttggatagtgatgatggagacacctatttggactggtacctgcagaagccagggcagtctccacagctcctgatctatacgctttcctatcgggcctctggagtcccagacaggttcagtggcagtgggtcaggcactgatttcacactgaaaatcagcagggtggaggctgaggatgttggagtttattactgcatgcaacgtatagagtttccgctcactttcggcggagggaccaaggtggagatcaaacga

SEQ ID NO: 488 - DNA, 330 bp, Artificial Sequence
  Description of Artificial Sequence: Synthetic polynucleotide
gaaattatgttgacgcagtctccaggcaccctgtctttgtctccaggggaaagggccaccctctcctgcagggccagtcagagggttcccagcagctacatagtctggtaccagcagaaacctggccaggctcccaggctcctcatctatggttcatccaacagggccactggcatcccagacaggttcagtggcagtgggtctgggacagacttcactctcaccatcggcagactggagcctgaagattttgcagtgtactactgtcagcagtatggtagctcacctccgtggacgttcggccaagggaccaaggtggcaatcaaacga

SEQ ID NO: 489 - DNA, 321 bp, Artificial Sequence
  Description of Artificial Sequence: Synthetic polynucleotide
tcctatgagctgactcagccaccctcagtgtccgtgtccccaggacagacagccagcatcacctgctctggaaataaattgggggataaatatgtttgctggtatcagcagaagccaggccagtcccctgtcttggtcatctatcaagatagcaagcggccctcagggatccctgagcgattctctggctccaactctgggaacacagccactctgaccatcagcgggacccaggctttggatgaggctgactattactgtcaggcgtgggacagcagcacttgggtgttcggcggagggaccaagctgaccgtcctaggt

SEQ ID NO: 490 - DNA, 330 bp, Artificial Sequence
  Description of Artificial Sequence: Synthetic polynucleotide
gaaattatgttgacgcagtctccaggcaccctgtctttgtctccaggggaaagagccaccctctcctgcagggccagtcagagagttcccagcagctacttagtctggtaccagcagaaacctggccaggctcccaggctcctcatctatggtgcatccaacagggccacaggcatcccagacaggttcagcggcagtgggtctgggacagacttcactctcaccatcggcagactggagcctgaagattttgcagtgtattactgtcagcagtatggtagttcacctccgtggacgttcggccaagggaccaaggtggcaatcaaacga

SEQ ID NO: 491 - DNA, 324 bp, Artificial Sequence
  Description of Artificial Sequence: Synthetic polynucleotide
gacatccagatgacccagtctccatcctccctgtctgcatctataggagacagagtcaccatcacttgccgggcaagtcagagcattagcaactatttaaattggtttcagcagatcccagggaaagcccctaggctcctgatctatgcagcttccagtttgcaaagtggggtcccatcgaggttcagtggcagtggatctgggacagatttcactctcaccatcagcagtctgcaacctgaagattttgcaatttactactgtcaacagagttccagtatcccttggacgttcggccaagggaccaaggtggaaatcaaacga

SEQ ID NO: 492 - DNA, 327 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttagcagagactacttagcctggtaccggcagaaacctggccaggctcccaggctcctcatctatggtgcatccagcagggccactggcatcccagacagattcagtggcagtgggtctgggacagacttcactctcaccatcagcagactggagcctgaagattttgcagtgtattactgtcagcaatatggtagatcactattcactttcggccctgggaccacagtggatatcaaacga

SEQ ID NO: 493 - DNA, 327 bp, Artificial Sequence
  Description of Artificial Sequence: Synthetic polynucleotide
tcctatgagctgacacagccaccctcggtgtctgtgtccccaggccaaacggccaggatcacctgctctggagatgcagtgccaaaaaaatatgctaattggtaccagcagaagtcaggccaggcccctgtgctggtcatctatgaggacagcaaacgaccctccgggatccctgagagattctctggctccagctcagggacaatggccaccttgactatcagtggggcccaggtggaggatgaagctgactactactgttactcaacagacagcagtggtaatcatgtggtattcggcggagggaccaagctgaccgtcctaggt

SEQ ID NO: 494 - DNA, 321 bp, Artificial Sequence
  Description of Artificial Sequence: Synthetic polynucleotide
tcctatgagttgactcagccaccctcagtgtccgtgtccccaggacagacagccagcatcacctgctctggagataaattgggggataaatacgtttgctggtatcagcagatgccaggccagtcccctgtgttggtcatccatcaaaataacaagcggccctcagggatccctgagcgattctctggctccaactctgggaacacagccactctgaccatcagcgggacccaggctatggatgaggctgactattattgtcaggcgtgggatagtagtactgcggtattcggcggagggaccaagctgaccgtcctaggt

SEQ ID NO: 495 - DNA, 324 bp, Artificial Sequence
  Description of Artificial Sequence: Synthetic polynucleotide
gaaacagtgatgacgcagtctccagccaccctgtctgtgtctccaggggaaagagccaccctctcctgcagggccaggcagagtgttggcagtaacttaatctggtaccagcagaaacctggccaggctcccaggctcctcatctttggtgcatccagcagggacactggtatcccagccaggttcagtggcagtgggtctgggacagagttcactctcaccatcagcagcctgcagtctgaagattttgcagtttattactgtcagcagtataataattggcctctcactttcggcggagggaccaaggtggagatcaaacga

SEQ ID NO: 496 - DNA, 324 bp, Artificial Sequence
  Description of Artificial Sequence: Synthetic polynucleotide
gacatccagatgacccagtctccatcctccctgtctgcatctgtaggagacagagtcaccatcacttgccggacaagtcagagcattagcaactatttaaattggtatcagcagaaaccaggaaaagcccctaacctcctgatctatgctgcatccagtttgcaaagtggggtcccatcaagattcagtggcagtggatctgggacagatttcactctcaccatcagcggtctgcaacctgaggatttttcaacttactactgtcaacagagttacagtacctcgctcactttcggcggagggaccaaggtggagatcaaacga

SEQ ID NO: 497 - DNA, 327 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttgccagcagttacttagtctggtaccaacagaaacctggccaggctcccaggctcctcatctatggtgcattcagcagggccactggcatcccagacaggttcagtggcagtgggtctgggacagacttcactctcaccatcaggagactggagcctgaagattttgcagtgtattactgtcagcagtatggtacctcaccatttactttcggccctgggaccaaagtggatctcaaacga

SEQ ID NO: 498 - DNA, 342 bp, Artificial Sequence
  Description of Artificial Sequence: Synthetic polynucleotide
gacattgtgatgacccagactccactctccctgcccgtcagccctggagagccggcctccatctcctgcaggtctagtcagagcctcttggatagtgatgatggagacacctatttggactggtacctgcagaagccagggcagtctccacagctcctgatctatacgctttcctatcgggcctctggagtcccagacaggttcagtgtcagtgggtcaggcactgatttcacactgaaaatcagcagggtggaggctgaggatgttggagtttattactgcatgcaacgtatagagtttccgctcactttcggcggagggaccaaggtggagatcaaacga

SEQ ID NO: 499 - DNA, 342 bp, Artificial Sequence
  Description of Artificial Sequence: Synthetic polynucleotide
gaaattgtgatgacccagactccactctccctgcccgtcacccctggagagccggcctccatctcctgcaggtctagtcagagcctcttcgataatgatgatggagacacctatttggactggtacctgcagaagccagggcagtctccacaactcctgatctatacgctttcctatcgggcctctggagtcccagacaggttcagtggcagtgggtcaggcactgatttcacactgaaaatcagcagggtggaggctgaggatgttggagtttattactgcatgcaacgtttagagtttccgatcaccttcgggcaagggacacgactggagattaaacga

SEQ ID NO: 500 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcgagtcaggacattagcaattatttagcctggtatcagcagaaaccagggaaagttcctacgctcctgatctatgctgcatccactttgctatcaggggtcccatctcggttcagtggcagtggatctgggacagatttcactctcaccatcagcagcctgcagcctgaagatgttgcagcttattactgtcaaaagtattacagtgcccctttcactttcggccctgggaccaaagtggatatcaaccga

SEQ ID NO: 501 - DNA, 324 bp, Artificial Sequence
  Description of Artificial Sequence: Synthetic polynucleotide
gacatccagatgacccagtctccatcctccctgtctgcatctgtaggagacagagtcactatcacttgccgggcaagtcagggcattagaaatgatttaggctggtatcagcagaaaccagggaaagcccctaaccgcctgatctatgctgcgtccagtttgcaaagtggggtcccatcaaggttcagcggcagtggatctgggacagaattcactctcacaatcagcagcctgcagcctgaagattttgcaacttattactgtctacagcataatagttaccctcggacgttcggccaagggaccaaggtggaaatcaaacga

SEQ ID NO: 502 - DNA, 339 bp, Artificial Sequence
  Description of Artificial Sequence: Synthetic polynucleotide
gatgttgtgatgactcagtgtccactctccctgcccgtcacccttggacagccggcctccatctcctgcaggtctagtcaaagactcgtatacagtgatggaaacacctacttgaattgggttcagcagaggccaggccaatctccaaggcgcctaatttataaggtttctaactgggactctggggtcccagacagattcagcggcagtgggtcaggcactgatttcacactgaaaatcagcagggtggaggctgaggatgttggggttaattactgcatggaaggtacacactggcctcgggacttcggccaagggacacgactggagattaaacga

SEQ ID NO: 503 - DNA, 324 bp, Artificial Sequence
  Description of Artificial Sequence: Synthetic polynucleotide
gacatccagatgacccagtctccatcctccctgtctgcatctataggagacagagtcaccatcacttgccgggcaagtcagagcattagcaactatttaaattggtttcagcagatcccagggaaagcccctagactcctgatctatgcagcttccagtttgcaaagtggggtcccatcgaggtttagtggcagtggatctgggacagatttcactctcaccatcagcagtctgcaacctgaagattttgcaacttactactgtcaacagagttccagtatcccttggacgttcggccaagggaccacggtggaaatcaaacga

SEQ ID NO: 504 - DNA, 324 bp, Artificial Sequence
  Description of Artificial Sequence: Synthetic polynucleotide
gacatagtgatgacgcagtctccagccaccctgtctgtgtctccaggggaaagagccaccctctcctgcagggccagtcagagtattagcagcaatttagcctggtaccagcagacacctggccaggctcccaggctcctcatctatggtacatccatcagggccagtactatcccagccaggttcagtggcagtgggtctgggacagagttcactctcaccatcagcagcctgcagtctgaagattttgcaatttattactgtcaccagtatactaactggcctcggacgttcggccaagggaccaaggtggaaatcaaacga

SEQ ID NO: 505 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagaccattagcatctatttaaattggtatcagcaaaaaccagggaaagcccctaagttcctgatctattctgcatccagtttgcaaagtggggtcccatcaaggttcagtggcagtggatctgggacagatttcactctcaccatcagcagtctgcaacctgaagatttttcaacttacttctgtcaacagagttacagttccccgctcactttcggcggagggaccaaggtggagatcaaacga

SEQ ID NO: 506 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagacttacagtgccccattcactttcggccctgggaccaaagtggatatcaaacga

SEQ ID NO: 507 - DNA, 327 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttagtcgcagccacttagcctggtaccagcagaactctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagttcaccgtggacgttcggccaagggaccaaggtggaaatcaaacga

SEQ ID NO: 508 - DNA, 324 bp, Artificial Sequence
  Description of Artificial Sequence: Synthetic polynucleotide
gacatccagatgacccagtctccatcctccctgtctgcatctattagagaccgagtcaccatcacttgccgggcaagtcagagcattggcacctttttaaattggtatcagcagaaaccagggacagcccctaagctcctgatctatgctgcgtccagtttgcaaagtggggtcccatcaaggttcagtggcagtggatctgggacagatttcactctcaccatcagcagtctacatcctgaagattttgcgtcttactattgtcaacagagtttcagtaccccgctcactttcggcggagggaccaaggtggagatcacacga

SEQ ID NO: 509 - DNA, 357 bp, Artificial Sequence
  Description of Artificial Sequence: Synthetic polynucleotide
caggtgcagcttatgcagtctggggctgaggtgaagaagcctggggcctcagtgaaggtctcctgcaaggcttctggatacaccttcaccggctactatatgcactgggtgcgacaggcccctggacaagggcttgagtggatgggatggatgaaccctaatagtggtgccacaaagtatgcacagaagtttcagggcagggtcaccatgaccagggacacgtccatcagcacagcctacatggagctgagcaggctgagatctgacgacacggccgtgtattactgtgcgagagaactcggtgactaccccttttttgactactggggccagggaaccctgggcatcgtctcctca

SEQ ID NO: 510 - DNA, 357 bp, Artificial Sequence
  Description of Artificial Sequence: Synthetic polynucleotide
caggtgcaactggtgcagtctggggctgaggtgaagaagcctggggcctcagtgaaggtctcctgcagggcttctgggtacaccttcaccggctactatatacactggatgcgacaggcccctggccatgggctggagtggatgggatggatcaaccctcccagtggtgccacaaactatgcacagaagtttcggggcagggtcgccgtgaccagggacacgtccatcagcacagtctacatggaactgagcaggctgagatctgacgacacggccgtatattactgtgcgagagagactggaacttggaacttctttgactactggggccagggaaccctggtcaccgtctcctca

SEQ ID NO: 511 - DNA, 360 bp, Artificial Sequence
  Description of Artificial Sequence: Synthetic polynucleotide
caggtgcagctggtgcagtctggggctgaggtgaagaagcctggggcctcagtgaaggtctcctgcaaggcatctggatacaccttcaccggctactatttgcactgggtgcgacaggcccctggacaagggcttgagtggatgggatggatcaaccctaacagtggtggcacagactatgcacagaagtttcagggccgggtcaccatgaccagggacacgtccatcagtacagcctacatggagctgagcaggctgagatctgacgacacggccgtgtattactgtgtgggagacgcagcaactggtcgctactactttgacaactggggccagggaaccctggtcaccgtctcctca

SEQ ID NO: 512 - DNA, 357 bp, Artificial Sequence
  Description of Artificial Sequence: Synthetic polynucleotide
caggtgcagctggtgcagtctggggctgaggtgaagaggcctggggcctcagtgaaggtctcctgcaaggcttctggatacaccttcaccggctactttatgcactgggtgcgacaggcccctggacaagggcttgagtggatgggatggatcaaccctaacagtggtgccacaaactatgcacagaagtttcacggcagggtcaccatgaccagggacacgtccatcaccacagtctacatggagctgagcaggctgagatctgacgacacggccgtgtattactgtacgagagaactggggatcttcaactggttcgacccctggggccagggaaccctggtcaccgtctcctca

SEQ ID NO: 513 - DNA, 369 bp, Artificial Sequence
  Description of Artificial Sequence: Synthetic polynucleotide
gaggtgcagctggtggagtctgggggaggcttggtacagcctggggggtccctgagactctcctgtgcagcctctggattcgccttcagtagttacgacatgcactgggtccgccaagctacaggaaaaggtctggagtgggtctcaactattgatactgctggtgacgcttactatccaggctccgtgaagggccgattcaccatctccagagaaaatgccaagacctccttgtatcttcaaatgaacagcctgagagccggggacacggctgtgtattactgtacaagagatcggagcagtggccggttcggggacttctacggtatggacgtctggggccaagggaccgcggtcaccgtctcctca

SEQ ID NO: 514 - DNA, 369 bp, Artificial Sequence
  Description of Artificial Sequence: Synthetic polynucleotide
gaggtgcagctggaggagtctgggggaggcttggtacagcctggggggtccctgagactctcctgtgcagcctctggattcaccttcaggacctacgacatgcactgggtccgccaagttacaggaaaaggtctggagtgggtctcagctattggtattgctggtgacacatactattcagactccgtgaagggccgattcaccatctccagagaaaatgccaagaactccctgtatcttcaaatgaacagtctaagagtcggggacacggctgtgtattactgtgcaagagatcggagcagtggccggttcggggactactacggtatggacgtctggggccaagggaccacggtcaccgtctcctca

SEQ ID NO: 515 - DNA, 375 bp, Artificial Sequence
  Description of Artificial Sequence: Synthetic polynucleotide
gaggtgcagctggtggagtctgggggagacttggtaaagcctggggggtcccttagactctcctgtgcagtctctggaatcactttcagtaacgcctggatgagctgggtccgccaggctccagggaaggggctggagtgggttggccgtattaaaagcaaaactgatggtgggacaacagactacgctgcacccgtgaaaggcagattcaccgtctcaagagatggttcaaaaaatacgctgtatctgcaaatgaacagcctgaaaaccgaggacacagccgtgtattactgtaccacagatagtagtgggagctactacgtggaggactactttgactactggggccagggaaccctggtcaccgtctcctca

SEQ ID NO: 516 - DNA, 375 bp, Artificial Sequence
  Description of Artificial Sequence: Synthetic polynucleotide
gaggtgcaactggtggagtctgggggaggcttggtaaagcctggggggtcccttagactctcctgtgcagcctctggattcactttcagtaacgcctggatgagctgggtccgccaggctccagggaaggggctggagtgggttggccgtattataggcaaaactgatggtgggacaacagactacgctgcacccgtgaaaggcagattcaccatttcaagagatgattcaaaaaacacgctgtatctgcaaatgaacagcctgaaaaccgaggacacagccgtgtattactgtacctcagatagtagtgggagctactacgtggaggactactttgactactggggccagggaaccctggtcgccgtctcctca

SEQ ID NO: 517 - DNA, 375 bp, Artificial Sequence
  Description of Artificial Sequence: Synthetic polynucleotide
gaggtgcaactggtggagtctgggggaggcttggtaaagccgggggggtcccttagactcgcctgtgcagcctctggaatcactttcaataacgcctggatgagttgggtccgccaggctccagggaaggggctggaatgggttggccgtattaaaagcaaaactgatggtgggacaacagactacgctgcacccgtgaaaggcagattcaccatctcaagagatgattcaaaaagtatactgtatctgcaaatgaacagcctgaaatccgaggacacagccgtgtattattgtaccacagatagtagtgggagctactacgtggaggactactttgactactggggccagggaaccctggtcaccgtctcctca

SEQ ID NO: 518 - DNA, 375 bp, Artificial Sequence
  Description of Artificial Sequence: Synthetic polynucleotide
caggtgcagctggtggagtctgggggaggcgtggtccagcctgggaggtccctgagactctcctgtgtagcctctggattcaccttcagtagctatggcatgcactgggtccgccaggatccaggcaaggggctggagtgggtggcagttatatcatatgatggaagtaacaaacactatgcagactccgtgaagggccgattcaccatctccagagacaattccaagaacacgctgtatctgcaaatgaacagcctgagagctgaggacacggctgtgtattactgtgcgagggaattactatggttcggggagtatggggtagaccacggtatggacgtctggggccaagggaccacggtcaccgtctcctca

SEQ ID NO: 519 - DNA, 369 bp, Artificial Sequence
  Description of Artificial Sequence: Synthetic polynucleotide
caggcgcagctggtggagtctgggggaggcgtggtccagcctgggaggtccctgagactctcctgtgcagcctctggattcaccttcagtagctatggcatacactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgactacggtgactaaggaggactactactactacggtatggacgtctggggccaagggaccacggtcaccgtctcctca

SEQ ID NO: 520 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcctcaggattcaccttcagtagctatggcatgcactgggtccgccaggctccaggcaaggggctggagtgggtggcaggtatatcatatgatggaagtaataaaaactatgcagactccgtgaagggccgaatcaccatctccagagacaatcccaagaacacgctgtatctgcaaatgaacagcctgagagctgaggacacggctgtgtattactgtgcgactacggtgactaaggaggactactactactacggtatggacgtctggggccaagggaccacggtcaccgtctcctca

SEQ ID NO: 521 - DNA, 357 bp, Artificial Sequence
  Description of Artificial Sequence: Synthetic polynucleotide
caggtgcaactggtggagtctgggggaggcgtggtccagcctgggaggtccctgagactctcctgtgcagcgtctggattcaccttcagttactattacattcactgggtccgccaggctccaggcaaggggctggagtgggtggcacttatatggtatgatggaagtaataaagactatgcagactccgtgaagggccgattcaccatctccagagacaattccaagaacacgctgtatctgcatgtgaacagcctgagagccgaggacacggctgtgtattactgtgcgagagaagggacaactcgacggggatttgactactggggccagggaaccctggtcaccgtctcctca

SEQ ID NO: 522 - DNA, 357 bp, Artificial Sequence
  Description of Artificial Sequence: Synthetic polynucleotide
caggtgcagctggtggagtctgggggaggagtggtccagcctgggaggtccctgagactctcctgtgcagcgtctggattcaccttcagtagctatggcatgcactgggtccgccaggctccaggcaaggggctggagtgggtggcagttatatgggatgatggaagtaataaatactatgcagactccgtgaagggccgattcaccatctccagagacaattccaagaacacgctgtctctgcaaatgaacagcctgagggccgaggacacggctgtttattactgtgcgagagaatacgtagcagaagctggttttgactactggggccagggaaccctggtcaccgtctcctca

SEQ ID NO: 523 - DNA, 354 bp, Artificial Sequence
  Description of Artificial Sequence: Synthetic polynucleotide
caggagcagctggtggagtctgggggaggcgtggtccagcctgggaggtccctgagactctcctgtgcagtgtctggattcaccttcagtttctatggcatgcactgggtccgccaggctccaggcaaggggctggagtgggtggcagttatatggtatgatggaagtaataaatactatgcagactccgtgaagggccgattcaccatctccagagacaattccaagaacacgctgtatttgcaaatgaacagcctgagagccgaggacacggctgtgtattactgtacgagagccctcaactggaacttttttgactactggggccagggaaccctggtcaccgtctcctca

SEQ ID NO: 524 - DNA, 354 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccctcagtaactataacatgcactgggtccgccaggctccaggcaaggggctggagtgggtggcagttttatggtatgatggaaatactaaatactatgcagactccgtgaagggccgagtcaccatctctagagacaattccaagaacacgctgtatcttcaaatgaacagcctgagagccgaggacacggctgtgtattactgtgcgagagatgtctacggtgactattttgcgtactggggccagggaaccctggtcaccgtctcctca

SEQ ID NO: 525 - DNA, 357 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatgggatgatggaagtaataaatactatgcagactccgtgaagggccgattcaccatctccagagacaattccaagaacacgctgtctctgcaaatgaacagcctgagggccgaggacacggctgtttattactgtgcgagagaatacgtagcagaagctggttttgactactggggccagggaaccctggtcaccgtctcctca

SEQ ID NO: 526 - DNA, 360 bp, Artificial Sequence
  Description of Artificial Sequence: Synthetic polynucleotide
caggtgcagctggtggagtctgggggaggcgtggtccagcctgggaggtccctgagactctcctgtacagcgtctggattcaccttcagtagctatggcatgcactgggtccgccaggctccaggcaaggggctggagtgggtggcagttatatggtatgatggaagtaataaataccatgcagactccgtgaagggccgattcaccatctccagagacgattccaagaacgcgctttatctgcaaatgaacagcctgagagccgaggacacggctgtgtattactgtgtgagagatcctggatacagctatggtcactttgactactggggccagggaaccctggtcaccgtctcctca

SEQ ID NO: 527 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaagactatgcagactccgtgaagggccgattcaccatctccagagacaattccaagaacacgctgtatctgcaaatgaacagcctgagagccgaggacacggctgtgtattactgtgcgagatcagcagtggctttgtacaactggttcgacccctggggccagggaaccctggtcaccgtctcctca

SEQ ID NO: 528 - DNA, 369 bp, Artificial Sequence
  Description of Artificial Sequence: Synthetic polynucleotide
caggtgcagctgcaggagtcgggcccaggactggtgaacccttcacagaccctgtccctcacctgcactgtctctggtggctccatcagcagtgatgcttactactggagctggatccgccagcacccagggaagggcctggagtggattgggtacatcttttacagtgggagcacctactacaacccgtccctcaagagtcgagttaccatttcagtagacacgtctaagaaccggttctccctgaagctgagctctgtgactgccgcggacacggccgtgtattactgtgcgagagagtctaggatattgtacttcaacgggtacttccagcactggggccagggcaccctggtcaccgtctcctca

SEQ ID NO: 529 - DNA, 360 bp, Artificial Sequence
  Description of Artificial Sequence: Synthetic polynucleotide
caggtgcagctgcaggagtcgggcccaggactggtgaagccttcacagaccctgtccctcacctgcgctgtctctggtggctccatcagcagtggtgattactactggagctggatccgccagcacccagggaagggcctggagtggattgggtacatctattacagtgggaccacctactacaacccgtccctcaagagtcgagttaccatatcagtagacacgtccaagaaccagttctccctgaagctgacctctgtgactgccgcggacacggccgtatattactgtgcgagaatgactactccttactggtacttcggtctctggggccgtggcaccctggtcactgtctcctca

SEQ ID NO: 530 - DNA, 360 bp, Artificial Sequence
  Description of Artificial Sequence: Synthetic polynucleotide
caggtgcagctgcaggagtcgggcccaggactggtgaagccttcacagaccctgtccctcacctgccctgtctctggtggctccatcagcagtggtgattattactggacctggatccgccagcacccagggaaggacctggagtggattacatacatctattacagtgggagcgcctactacaacccgtccctcaagagtcgagttaccatatcagtagacacgtctaagaaccagttctccctgaagctgagctctgtgactgccgcggacacggccgtatattattgtgcgaggatgactaccccttattggtacttcgatctctggggccgtggcaccctggtcactgtctcctca

SEQ ID NO: 531 - DNA, 360 bp, Artificial Sequence
  Description of Artificial Sequence: Synthetic polynucleotide
caggtgcagctgcaggagtcgggcccaggactggtgaagccttcacagaccctgtccctcacctgccctgtctctggtggctccatcagcagtggtgattactactggacctggatccgccagcacccagggaagggcctggagtggattgcatacatctattacagtgggagcacctactacaacccgtccctcaagagtcgagttaccatatcagtagacacgtctaagaaccagttctccctgaagctgagctctgtgactgccgcggacacggccgtatattactgtgcgaggatgactaccccttactggtacttcgatctctggggccgtggcaccctggtcactgtctcctca

SEQ ID NO: 532 - DNA, 360 bp, Artificial Sequence
  Description of Artificial Sequence: Synthetic polynucleotide
caggtgcagctgcaggagtcgggcccaggactggtgaagccttcacagaccctgtccctcacctgccctgtctctggtggctccatcagcagtggtgattactactggacctggatccgccagcacccagggaagggcctggagtggattgcatacatctattacactgggagcacctactacaacccgtccctcaagagtcgagttaccatatcagtagacacgtctaagaaccagttctccctgaagctgagctctgtgactgccgcggacacggccgtatattactgtgcgaggatgactaccccttactggtacttcgatctctggggccgtggcaccctggtcactgtctcctca

SEQ ID NO: 533 - DNA, 360 bp, Artificial Sequence
  Description of Artificial Sequence: Synthetic polynucleotide
caggtgcagctgcaggagtcgggcccaggactggtgaagccttcacagaccctgtccctcacctgccctgtctctggtggctccatcagcagtggtgattactactggacctggatccgccaacacccagggaagggcctggagtggattgcatacattttttacagtgggagcacctactacaacccgtccctcaagagtcgagttaccatatcacttgacacgtctaagaaccagttctccctgaagctgaactctgtgactgccgcggacacggccgtatattactgtgcgaggatgacttccccttactggtacttcgatctctggggccgtggcaccctggtcactgtctcctca

SEQ ID NO: 534 - DNA, 360 bp, Artificial Sequence
  Description of Artificial Sequence: Synthetic polynucleotide
caggtgcagctgcaggagtcgggcccaggactggtgaagccttcacagaccctgtccctcacctgccctgtctctggtggctccatcagcagtggtgattactactggacctggatccgccatcacccagggaagggcctggagtggattgcatacatttattacagtgggagcacctactacaacccgtccctcaagagtcgagttaccatatcagttgacacgtctaagaaccagttttccctgaagctgaactctgtgactgccgcggacacggccgtttattactgtgcgaggatgactaccccttactggtacttcgatctctggggccgtggcaccctggtcactgtctcctca

SEQ ID NO: 535 - DNA, 378 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcagtggtggttattactggagctggatccgccagcgcccagggaagggcctggagtgggttgggtacatctattacagtgggggcacccactacaacccgtccctcaaaagtcgagttaccatatcaatagacacgtctgagaaccagttctccctgaagctgagttctgtgactgccgcggacacggccgtgtattactgtgcgagagtcctccattactctgatagtcgtggttactcgtactactctgacttctggggccagggaaccctggtcaccgtctcctca

SEQ ID NO: 536 - DNA, 378 bp, Artificial Sequence
  Description of Artificial Sequence: Synthetic polynucleotide
caggtgcagctgcaggagtcgggcccaggactggtgaagccttcacagaccctgtccctcacctgcactctctctggtggctccttcagcagtggtgattactactggagctggatccgccagcacccagggaagggcctggagtggattgggtacatctattacagtgggagcacctactacaacccatccctcaagagtcgagttaccatatcaatagacacgtctaagaaccagttctccctgaaactgacctctgtgactgccgcggacacggccgtgtattactgtgcgagagtcctccattactatgatagtagtggttactcgtactactttgactactggggccagggaaccctggtcaccgtctcctca

SEQ ID NO: 537 - DNA, 360 bp, Artificial Sequence
  Description of Artificial Sequence: Synthetic polynucleotide
cagctgcagctgcaggagtcgggcccaggactggtgaagccttcggagaccctgtccctcacctgcactgtctctggtggctccatcagcagtgatacttcctactggggctggatccgccagcccccaggaaaggggctggagtggattgggaatatctattatagtgggaccacctacttcaacccgtccctcaagagtcgagtcagcgtatccgtagacacatccaagaaccagttctccctgaagctgagctctgtgaccgccgcagacacggctgtgttttattgtgcgagactccgaggggtctactggtacttcgatctctggggccgtggcaccctggtcactgtctcctca

SEQ ID NO: 538 - DNA, 357 bp, Artificial Sequence
  Description of Artificial Sequence: Synthetic polynucleotide
caggtgcagctacaggagtcgggtccaggactggtgaagccttcggagaccctgtccctcacctgcactgtctctggtggctccatcagtagttactactggagctggatccggcagcccccagggaagggactggagtggattgggtatatctattacactgggagcaccaactacaacccctccctcaagagtcgagtcaccatatcagtagacacgtccaagaaccagttctccctgaagctgagctctgtgaccgctgcggacacggccgtgtattactgtgcgagagaatattactatggttcggggagttattatccttggggccagggaaccctggtcaccgtctcctca

SEQ ID NO: 539 - DNA, 357 bp, Artificial Sequence
  Description of Artificial Sequence: Synthetic polynucleotide
caggtgcagctgaaggagtcgggcccaggactggtgaagccttcggagaccctgtccctcacctgcactgtctctggtggctccatcagtagttactactggagctggatccggcagcccccagggaagggactggagtggattgggtatatctattacagtgggaacaccaactacaacccctccctcaagagtcgagtcaccatatcagtagacacgtccaagaaccagttctccctgaagctgagctctgtgaccgctgcggacacggccgtgtattactgtgcgagagaatattactatggttcggggagttattatccttggggccagggaaccctggtcaccgtctcctca

SEQ ID NO: 540 - DNA, 369 bp, Artificial Sequence
  Description of Artificial Sequence: Synthetic polynucleotide
cagattcagctgctggagtcgggcccaggactggtgaagccttcggagaccctgtccctcacctgcactgtctctggtggctccgtcagtagtggtgattactactggagctggatccggcagcccccagggaagggactggagtggattgggtttatctattacagtgggggcaccaactacaacccctccctcaagagtcgagtcaccatatcaatagacacgtccaagaaccagttctccctgaagctgaactctgtgaccgctgcggacacggccgtgtattactgtgcgagatatagcagcacctgggactactattacggtgtggacgtctggggccaagggaccacggtcaccgtctcctca

SEQ ID NO: 541 - DNA, 369 bp, Artificial Sequence
  Description of Artificial Sequence: Synthetic polynucleotide
caggtgcagctgcaggagtcgggcccaggactggtgaagccttcggagaccctgtccctcacctgcactgtctctggtgactctgtcagcagtggtgataactactggagctggatccggcagcccccagggaagggactggagtggattgggttcatgttttacagtgggagtaccaactacaacccctccctcaagagtcgagtcaccatatcactacacacgtccaagaaccagttctccctgaggctgagctctgtgaccgctgcggacacggccgtgtattactgtgggagatataggagtgactgggactactactacggtatggacgtctggggccaagggaccacggtcaccgtctcctca

SEQ ID NO: 542 - DNA, 369 bp, Artificial Sequence
  Description of Artificial Sequence: Synthetic polynucleotide
gaggtgcagctggtgcagtctggagcagaggtgaaaaagcccggggagtctctgaagatctcctgtaagggttctggatacagctttaccagttactggatcggctgggtgcgccagatgcccgggaaaggcctggagtggatggggatcatctatcctggtgactctgataccagatacagcccgtccttccaaggccaggtcaccatctcagccgacaagtccatcaacaccgcctacctgcagtggagcagcctgaaggcctcggacaccgccatatacttctgtgcgagacgggcctcacgtggatacagatttggtcttgcttttgcgatctggggccaagggacaatggtcaccgtctcctca

SEQ ID NO: 543 - DNA, 369 bp, Artificial Sequence
  Description of Artificial Sequence: Synthetic polynucleotide
gaggtgcagctggtgcagtctggagcagaggtgaaaaagcccggggagtctctgaagatctcctgtcagggttctggatacagctttagcagttactggatcggctgggtgcgccagatgcccgggaaaggcctggagtggatggggatcatctatcctggtgactctgataccagatacagcccgtccttccaaggccaggtcaccatctcagccgacaagtccatcaataccgcctacctgcagtggagcagcctgaaggcctcggacaccgccatatattactgtgcgagacgggcctcacgtggatacagatatggtcttgcttttgctatctggggccaagggacaatggtcaccgtctcttca

SEQ ID NO: 544 - DNA, 360 bp, Artificial Sequence
  Description of Artificial Sequence: Synthetic polynucleotide
gaggtgcagctggtgcagtctggagcagaggtgaaaaagcccggggagtctctgaagatctcctgtaagggttctggatacagttttaccagttattggatcggctgggtgcgccagatgcccgggaaaggcctggagtggatggggatcatctatcctggtgactctgaaaccagatacagcccgtcctttcaaggccaggtcaccatctcagccgacaagtccatcagcaccgcctacctgcagtggaacagcctgaagacctcggacaccgccatgtatttctgtgcgaccgtagcagtgtctgccttcaactggttcgacccctggggccagggaaccctggtcaccgtctcctcc

SEQ ID NO: 545 - DNA, 384 bp, Artificial Sequence
  Description of Artificial Sequence: Synthetic polynucleotide
caggtgcagctgaaggagtcgggcccaggactggtgaagccttcacagaccctgtccctcacctgcactgtctctggtggctccatcagcagtggtggttactactggaactggatccgccagcacccagggaagggcctggagtggattgggtacatctatgacagtgggagcacctactacaacccgtccctcaagagtcgagttaccatgtcagtagacacgtctaagaaccagttctccctgaagttgagctctgtgactgccgcggacacggccgtgtattactgtgcgagagatgttctaatggtgtatactaaagggggctactactattacggtgtggacgtctggggccaagggaccacggtcaccgtctcctca

SEQ ID NO: 546 - DNA, 369 bp, Artificial Sequence
  Description of Artificial Sequence: Synthetic polynucleotide
gaggtgcagctggtgcagtctggagcagaggtgaaaaagcccggggagtctctgaagatctcctgtaagggttctggatacagctttaccggctactggatcggctgggtgcgccagctgcccgggaaaggcctggagtggatggggatcatctatcctggtgactctgataccagatacagcccgtccttccaaggccaggtcaccatctcagtcgacaagtccatcaacaccgcctacctgcagtggagcagcctgaaggcctcggacaccgccatgtattactgtgcgagacgggcctcacgtggatacagctatggtcatgcttttgatttctggggccaagggacaatggtcaccgtgtcttca

SEQ ID NO: 547 - DNA, 351 bp, Artificial Sequence
  Description of Artificial Sequence: Synthetic polynucleotide
caggtgcagctacagcagtggggcgcaggactgttgaagccttcggagaccctgtccctcacctgctctgtctatggtgggtccttcagtggttactactggacctggatccgccagcccccagggaaggggctggagtggattggggaaatcaatcatagtgaaaacaccaactacaacccgtccctcaagagtcgagtcaccatatcaatagacacgtccaagaaccagttctccctgaagctgagctctgtgaccgccgcggacacggctgtgtattactgtgcgagagagagtgggaacttcccctttgactactggggccagggaaccctggtcaccgtctcctca

SEQ ID NO: 548 - DNA, 363 bp, Artificial Sequence
  Description of Artificial Sequence: Synthetic polynucleotide
caggtgcagctacagcagtggggcgcaggaccgttgaagccttcggagaccctgtccctcacctgcgctgtctatggtgggtccatcagtggttactactggagctggatccgccagcccccagggaaggggctggagtggattggggaaatcactcatactggaagctccaactacaacccgtccctcaagagtcgagtcaccatatcagtagacacgtccaagaaccagttctccctgaagctgagctctgtgaccgccgcggacacggctgtgtattactgtgcgagaggcgggattttatggttcggggagcaggcttttgatatctggggccaagggacaatggtcaccgtctcttca

SEQ ID NO: 549 - DNA, 360 bp, Artificial Sequence
  Description of Artificial Sequence: Synthetic polynucleotide
gaggtgcagctggtggagtctgggggaggcctggtcaagcctggggggtccctgagactctcctgtacagcctctggattcaccttcagaagctatagcatgaactgggtccgccaggctccggggaaggggctggagtgggtctcatccattagtagtagtagtagttacgaatactacgtagactcagtgaagggccgattcaccatctccagagacatcgccaagagctcactgtggctgcaaatgaacagcctgagagccgaggacacggctgtgtattactgtgcgagatccctaagtatagcagtggctgcctctgactactggggcaagggaaccctggtcaccgtctcctca

SEQ ID NO: 550 - DNA, 375 bp, Artificial Sequence
  Description of Artificial Sequence: Synthetic polynucleotide
caggtgcaactggtgcagtctggggctgaggtgaagaagcctggggcctcagtgaaggtctcctgcaaggcttctggatacaccttcaccggctactataagcactgggtgcgacaggcccctggacaagggcttgagtggatgggatggatcaaccctaacagtggtgccacaaagtatgcacagaagtttcagggcagggtcaccatgaccagggacacgtccatcagcacagtgtacatggagctgagcaggctgagatctgtcgacacggccctgtattactgtgcgagagaggtacccgacggtatagtagtggctggttcaaatgcttttgatttctggggccaagggacaatggtcaccgtctcttca

SEQ ID NO: 551 - DNA, 387 bp, Artificial Sequence
  Description of Artificial Sequence: Synthetic polynucleotide
caggtgcacctggtggagtctgggggaggcgtggtccagcctgggaggtccctgagactctcctgtgcagcgtctggattcaccttcagtaactatggcatgcactgggtccgccaggctccaggcaaggggctggagtgggtggcaattatatggtatgatggaagtaataaaaactatgcagactccgtgaagggccgcttcaccatctccagagacaattccaagaacacgctgtatctggaaatgaacagcctgagagccgaggacacggctgtgtattactgtgcgagagatcaggattacgatttttggagtggttatccttacttctactactacggtatggacgtctggggccaagggaccacggtcaccgtctcctca

SEQ ID NO: 552 - DNA, 360 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccagttatgatatcgactgggtgcgacaggccactggacaagggcttgagtggatgggatggatgaaccctaacggtggtaacacaggctatgcacagaagttccagggcagagtcaccatgaccaggaacacctccataaacacggcctatatggaactgagcagcctgagatctgaggacacggccatatattactgtgcgagagggaaggaatttagcagggcggagtttgactactggggccagggaaccctggtcaccgtctcctca

SEQ ID NO: 553 - DNA, 387 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatggcatgcgctgggtccgccaggctccaggcaaggggctggagtgggtggcacttatatggtatgatggaagtaataagttctatgcagactccgtgaagggccgattcaccatctccagagacaattccaagaacacgctgaatctgcaaatgaacagcctgagagccgaggacacggctgtgtattactgtgcgagagatcggtattacgatttttggagtggttatccatacttcttctactacggtctggacgtctggggccaagggaccacggtcaccgtctcctca

SEQ ID NO: 554 - DNA, 369 bp, Artificial Sequence
  Description of Artificial Sequence: Synthetic polynucleotide
caggtcaccttgaaggagtctggtcctgtgctggtgaaacccacagagaccctcacgctgacctgcaccgtctctgggttctcactcagtaatcctagaatgggtgtgagctggatccgtcagcccccagggaaggccctggagtggcttacacacattttttcgaatgacgaaaaatcctacagcacatctctgaagagcaggctcaccatctccaaggacacctccaaaagccaggtggtcctttccatgaccaacatggaccctgtggacacagccacatattactgtgtacgggtagataccttgaactaccactactacggtatggacgtctggggccaagggaccacggtcaccgtctcctca

SEQ ID NO: 555 - DNA, 357 bp, Artificial Sequence
  Description of Artificial Sequence: Synthetic polynucleotide
caggtgcagctggtgcagtctggggctgaggtgaagaagcctggggcctcagtgaaggtctcctgcatggcatctggatacattttcaccagttacgatatcaactgggtgcgacaggccactggacaagggcctgagtggatgggatggatgaacccctacagtgggagcacaggctatgcacagaatttccagggcagagtcaccatgaccaggaatacctccataaacacagcctacatggagctgagcagcctgagatctgaggacacggccgtgtattactgtgcgaagtataattggaactatggggcttttgatttctggggccaagggacaatggtcaccgtctcttca

SEQ ID NO: 556 - DNA, 375 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgttgtatctgcaaatgaacagcctgagagctgaggacacggctgtgtattactgtgcgagagcggacggtgactacccatattactactactactacggtatggacgtctggggccaagggaccacggtcaccgtctcctca

SEQ ID NO: 557 - DNA, 363 bp, Artificial Sequence
  Description of Artificial Sequence: Synthetic polynucleotide
gaggtgcagctgttggagtctgggggaggcttggtacagccgggggggtccctgagactctcctgtgcagcctctggattcacctttcgcaactatgccatgagctgggtccgccaggctccagggaaggggctggagtgggtctcaggtattagtggtagtagtgctggcacatactacgcagactccgtgaagggccggttcaccatctccagagacaattccaagaacacgctgtttctgcaaatggacagcctgagagccgaggacacggccgtatattactgtgcgcaagattggagtatagcagtggctggtacttttgactactggggccagggaaccctggtcaccgtctcctca

SEQ ID NO: 558 - DNA, 354 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacaatgggagtccctacgacaacccgtccctcaagaggcgagttaccatctcaatagatgcgtctaagaaccagttctccctgaagctgagctctatgactgccgcggacacggccgtgtattactgtgcgagaggggccctctacggtatggacgtctggggccaagggaccacggtcaccgtctcctca

SEQ ID NO: 559 - DNA, 348 bp, Artificial Sequence
  Description of Artificial Sequence: Synthetic polynucleotide
caggtgcagctacagcagtggggcgcaggactgttgaagccttcggagaccctttccctcacctgcgctgtctatggtgggtccttcagtggttactactggagctggatccgccagcccccagggaaggggctggagtggattggggaactcgatcatagtggaagtatcaactacaacccgtccctcaagagtcgagtcaccatatcagtagacacgtccaagaaccagttctccctgaagctgacctctgtgaccgccgcggacacggctgtgtattactgtgcgagagtcctgggatctactcttgactattggggccagggaaccctggtcaccgtctcctca

SEQ ID NO: 560 - DNA, 366 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagttatagcatgaactgggtccgccaggctccagggaaggggctggagtgggtctcatccattagtagtagtagtacttacatatactacgcagactcagtgaagggccgattcaccatctccagagacaacgccaagaactcactgtatctgcaaatgaacagcctgagagccgaggacacggctgtgtattactgtgcgagagatacttatatcagtggctggaactacggtatggacgtctggggccaagggaccacggtcaccgtctcctca

SEQ ID NO: 561 - DNA, 357 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatttgcactgggtgcgacaggcccctggacaagggcttgagtggatgggatggatcaaccctaacagtgctgccacaaactatgcaccgaagtttcagggcagggtcaccgtgaccagggacacgtccatcagcacagcctacatggaactgagcaggctgagatctgacgacacggccgtgtattactgtgcgagagagggtggaacttacaactggttcgacccctggggccagggaaccctggtcaccgtctcctca

SEQ ID NO: 562 - DNA, 345 bp, Artificial Sequence
  Description of Artificial Sequence: Synthetic polynucleotide
caggtgcagctgcaggagtcgggcccaggactgatgaagccttcggagaccctgtccctcacctgcactgtctctggtggctccatcagttattattactggagttggatccggcagtccccagggaagggactggagtggattgggtatatctattatagtgggagcaccaactacaacccctccctcaagagtcgagtcaccatgtcagtagacacgtccaagaaccagttctccctgaagctgagctctgtgaccgctgcggacacggccgtgtattactgtgcgtctggaactagggcttttgatatctggggccaagggacaatggtcaccgtctcttca

SEQ ID NO: 563 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaagggcctggagtgggtggcagttatatggtatgatggaagtaataactattatgcagactccgtgaagggccgattcaccatctccagagacaattccaagagcacgctgtttctgcaaatgaacagcctgagagccgaggacacggctatatattactgtgcgagagatcgggcgggagcctctcccggaatggacgtctggggccaagggaccacggtcaccgtctcctca

SEQ ID NO: 564 - DNA, 366 bp, Artificial Sequence
  Description of Artificial Sequence: Synthetic polynucleotide
caggtgcaactggtgcagtctggggcggaggtgaagaagcctggggcctcagtgaaggtctcctgcaaggcttctggattcaccttcatcggctactatacacactgggtgcgacaggcccctggacaagggcttgagtggatgggatggatcaaccctagcagtggtgacacaaagtatgcacagaagtttcagggcagggtcaccttggccagggacacgtccatcagcacagcctacatggagctgagcaggctgagatctgacgacacggccgtgtattactgtgcgaacagtggctggtacccgtcctactactacggtatggacgtctggggccaagggaccacggtcaccgtctcctca

SEQ ID NO: 565 - DNA, 363 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcagtacttactactggagctggatccggcagcccccagggacgggactggaatggattgggtatatcttttacaatgggaacgccaactacagcccctccctgaagagtcgagtcaccttttcagtggacacgtccaagaaccagttctccctgaaactgagttctgtgaccgctgcggacacggccgtgtatttttgtgcgagagaaacggactacggtgactacgcacgtccttttgaatactggggccagggaaccctggtcaccgtctcctca

SEQ ID NO: 566 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtacctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagaggccactatgatagtagtggtcccagggactactggggccagggaaccctggtcaccgtctcctca

SEQ ID NO: 567 - DNA, 366 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagtagctatggcatgcactgggtccgccaggctccaggccaggggctggagtgggtggcacttatatcatatgatggaagtaataaatactatgcagactccgtgaagggccgattcaccatctccagagacaaatccaagaacacgctgtatctgcaaatgaacagcctgagagctgaggacacggctgtatattactgtgcgagagaggctaactggggctacaactactacggtatggacgtctggggccaagggaccacggtcaccgtctcctca

SEQ ID NO: 568 - DNA, 366 bp, Artificial Sequence
  Description of Artificial Sequence: Synthetic polynucleotide
caggtgcagctacagcagtggggcgcaggactgttgaagccttcggagaccctgtccctcacctgcgctgtctatggtgggtccttcagtgattactactggaactggatccgccagcccccagggaaggggccagagtggattggggaaatcaatcatagtggaaccaccaactacaatccgtccctcaagagtcgagtcaccatatcagtagacacgtccaagaaccagttctccctgaagctgagctctgtgaccgccgcggacacggctgtatattactgtgtggggatattacgatattttgactggttagaatactactttgactactggggccagggaaccctggtcaccgtctcctca

SEQ ID NO: 569 - DNA, 357 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctcacagtggtaacacaggctatgcacagaagttccagggcagagtcaccatgaccaggaacacctccataaatacagcctacatggagctgagcagcctgagatctgaggacacggccgtgtattactgtgcgaaatataactggaactacggcgcttttgatttctggggccaagggacaatggtcaccgtctcttca

SEQ ID NO: 570 - DNA, 357 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgagctgggtccgccaggctccggggaaggggctggagtgggtctcagctattagtggtagtggtcgtaccacatactccgcagactccgtgaagggccggttcaccatctccagagacaattccaagaacacgctgtatctgcaaatgaacagcctgagagccgaggacacggccgtatattactgtgcgaaagaacagcagtggctggtttattttgactactggggccagggaaccctggtcaccgtctcctca

SEQ ID NO: 571 - DNA, 381 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcaccagtggtgtttactactggaactggatccgccagcacccagggaagggcctggagtggattgggtacctctattacagtgggagcacctactacaacccgtccctcaagagtcgccttaccatttcagcagacatgtctaagaaccagttctccctaaagctgagctctgtgactgtcgcggacacggccgtgtattactgtgcgagagatggtattactatggttcggggagttactcactactacggtatggacgtctggggccaagggaccacggtcaccgtctcctca

SEQ ID NO: 572 - DNA, 351 bp, Artificial Sequence
  Description of Artificial Sequence: Synthetic polynucleotide
caggtgcagctacagcagtggggcgcaggactgttgaagccttcggagaccctgtccctcacttgcgctgtctatggtgggtccttcagtggttactactggagctggatccgccagcccccagggaagggtctggagtggattggggaaatcaatcatagtgaaaacaccaactacaacccgtccctcaagagtcgagtcaccatatcactagacacgtccaatgaccagttctccctaagactaacctcagtgaccgccgcggacacggctgtctattactgtgcgagagtaactggaacggatgcttttgatttctggggccaagggacaatggtcaccgtctcttca

SEQ ID NO: 573 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctttggcatgcactgggtccgccaggctccaggcaaggggctggagtgggtggcacttatatggtatgatggagataataaatactatgcagactccgtgaagggccgattcaccatctccagagacaattccaagaacacgctgtatctgcaaatgaacagcctgagagccgaggacacggctgtgtattactgtgcgagaaacagtggctgggattacttctactactacggtatggacgtctggggccaagggaccacggtcaccgtctcctca

SEQ ID NO: 574 - DNA, 348 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcagtagttactactggagctggatccggcagcccgccgggaagggactggagtggattgggcgtatctatatcagtgggagcaccaactacaacccctccctcgagaatcgagtcaccatgtcaggagacacgtccaagaaccagttctccctgaagctgaattctgtgaccgccgcggacacggccgtatattactgtgcgggaagtgggagctactcctttgactactggggccagggaaccctggtcaccgtctcctca

SEQ ID NO: 575 - DNA, 387 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccttcagtagctatggcctgcactgggtccgccaggctccaggcaaggggctggagtgggtggcagttatatggaatgatggaagtaataagctttatgcagactccgtgaagggccgattcaccatctccagagacaattccaagaacacgctgtatctgcaaatgaacagcctgagagccgaggacacggctgtgtattactgtgcgagagatcagtattacgatttttggagcggttacccatactatcactactacggtatggacgtctggggccaagggaccacggtcaccgtctcctca

SEQ ID NO: 576 - DNA, 366 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagttatagcatgaactgggtccgccaggctccagggaaggggctggagtgggtctcatccattagtagtagtagtacttacatatactacgcagactcagtgaagggccgattcaccatctccagagacaacgccaagaactcactgtatctgcaaatgaacagcctgagagccgaggacacggctgtgtattactgtgcgagagatatctatagcagtggctggagctacggtatggacgtctggggccaagggaccacggtcaccgtctcctca

SEQ ID NO: 577 - DNA, 366 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaagggactggagtgggtggcagttatatggtatgatggaagttatcaattctatgcagactccgtgaagggccgattcaccatctccagagacaattccaagaacacgttgtatctgcaaatgaacagcctgagagccgaggacacggctgtgtattactgtgcgagagatcacgtttggaggacttatcgttatatctttgactactggggccagggaaccctggtcaccgtctcctca

SEQ ID NO: 578 - DNA, 351 bp, Artificial Sequence
  Description of Artificial Sequence: Synthetic polynucleotide
gaggtgcagctggtgcagtctggaccagaggtgaaaaagcccggggagtctctgaagatctcctgtaagggttcgggatacagtttaaccagctactggatcggctgggtgcgccagatgcccgggaaaggcctggagtggatggggatcatctatcctggtgactctgataccagatacagcccgtccttccaaggccaggtcaccatctcagccgacacgtccatcagcaccgcctacctgcagtggagcaggttgaaggcctcggacaccgccgtatattactgtgcgagggcacaactggggatctttgactactggggccagggaaccctggtcaccgtctcctca

SEQ ID NO: 579 - DNA, 351 bp, Artificial Sequence
  Description of Artificial Sequence: Synthetic polynucleotide
caggtgcaactacagcagtggggcgcaggactgttgaagccttcggagaccctgtccctcacttgcgctgtctatggtgggtccttcagtggttactactggagctggatccgccagcccccagggaagggtctggagtggattggggaaatcaatcatagtgaaaacaccaactacaacccgtccctcaagagtcgagtcaccatatcactagacacgtccaataagcagttctccctaagactaacctctgtgaccgccgcggacacggctgtctattactgtgcgagagtaactggaacggatgcttttgatttctggggccaagggacaatggtcaccgtctcttca

SEQ ID NO: 580 - DNA, 360 bp, Artificial Sequence
  Description of Artificial Sequence: Synthetic polynucleotide
cagttgcagttgcaggaatcgggcccaggactggtgaagccttcggagaccctgtccctcacctgcactgtctctggtgactccatcagtagtagtagttactactggggctggatccgccagcccccagggaaggggctggagtggattgggatgatctattatagtgggaccacctactacaacccgtccctcaagagtcgagtcaccatatccgtagacacgtccaagaatcagttttccctgaagctgagttctgtgaccgccgcagacacggctgtgtattattgtgcgagagtggcagcagtttactggtatttcgatctctggggccgtggcaccctggtcactgtctcctca

SEQ ID NO: 581 - DNA, 381 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcaccagtggtgtttactactggagctggatccgccagctcccagggaagggcctggagtggattgggtacatctattacagtgggagcacctactacaacccgtccctcaagagtcgccttaccatatcagcagacacgtctaagaaccagttctccctaaagctgagctctgtgactgtcgcggacacggccgtgtattactgtgcgagagatggtattactatggttcggggagttactcactactacggtatggacgtctggggccaagggaccacggtcaccgtctcctca

SEQ ID NO: 582 - DNA, 369 bp, Artificial Sequence
  Description of Artificial Sequence: Synthetic polynucleotide
caggtacagctgcagcagtcaggtccaggactggtgaagccctcgcagaccctctcactcacctgtgccatctccggggacagtgtctctagcaacagtgctacttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgtgggtattgtagtagtaccagctgttctctttgactactggggccagggaaccctggtcaccgtctcctca

SEQ ID NO: 583 - DNA, 387 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatggcatgcactgggtccgccaggctccaggcaaggggctggagtgggtggcagttatatggaatgatggaaataacaaatactatgcagactccgtgaagggccgattcaccatctccagagacaattccaagaacacgctatatctgcaaatgaacagcctgagagccgaggacacggctgtgtattactgtgcgagagatcagaattacgatttttggaatggttatccctactacttctactacggtatggacgtctggggccaagggaccacggtcaccgtctcctca

SEQ ID NO: 584 - DNA, 366 bp, Artificial Sequence
  Description of Artificial Sequence: Synthetic polynucleotide
caggtgcaggtggtggagtctgggggaggcttggtcaagcctggagggtccctgagactctcctgtgcagcctctggattcaccttcagtgactcctacatgagctggatccgccaggctccagggaaggggctggagtggatttcttccattagtagtagtggtagtatcgtatacttcgcagactctgtgaagggccgattcaccatctccagggacatcgccaagaactcactgtatctgcacatgaacagcctgagagccgaggacacggccgtgtattactgtgcgagagagacgtttagcagtggctggttcgatgcttttgatatctggggccaagggacaatggtcaccgtctcttca

SEQ ID NO: 585 - DNA, 366 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatagcatgagttgggtccgccaggctccagggaaggggctggagtgggtctcatccattagtagtagtagtacttacatatactacgcagactcactgaagggccgattcaccatctccagagacaacgccaagaactcactgtttctgcaagtgaacagcctgagagccgaagactcggctgtgtattactgtgcgagagatcgatggagcagtggctggaacgaaggttttgactattggggccagggaaccctggtcaccgtctcctca

SEQ ID NO: 586 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagtaactatggcatgcactgggtccgccaggctccaggcaaggggctggagtgggtggcaattacatcatatggaggaagtaataaaaattatgcagactccgtgaagggccgattcaccatctccagagacaattccaagaacacgctgtatctgcaaatgaacagcctgagagctgaggacacggctgtgtattattgtgcgagagaggccgggtatagctttgactactggggccagggaaccctggtcaccgtctcctca

SEQ ID NO: 587 - DNA, 363 bp, Artificial Sequence
  Description of Artificial Sequence: Synthetic polynucleotide
gaggtgcaactgttgggatctgggggaggcttggtacagcctggggggtccctgagactctcctgtgcagcctctggattcacctttaaccactatgccatgagctgggtccgccaggctccagggaaggggctggagtgggtctcagctattagtggtagtggtgctggcacattctacgcggactccatgaagggccggttcaccatctccagagacaattccgagaacacgctgcatctgcagatgaacagcctgagagccgaggacacggccatatattactgtgcgaaagatcttagaatagcagtggctggttcatttgactactggggccagggaaccctggtcaccgtctcctca

SEQ ID NO: 588 - DNA, 387 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaacttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgttttactgtgcgagagatcagtatttcgatttttggagtggttatcctttcttctactactacggtatggacgtctggggccaagggaccacggtcaccgtctcctca

SEQ ID NO: 589 - DNA, 366 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgagttgggtccgccaggctccagggaaggggctggagtgggtctcagttattagtgacagtggtggtagcacatactacgcagactccgtgaagggccggttcaccatctccagagacaattccaagaacacgctgtatctacaaatgaacagcctgagagccgaggatacggccgtatattactgtgcgaaagatcatagcagtggctggtactactacggtatggacgtctggggccaagggaccacggtcaccgtctcctca

SEQ ID NO: 590 - DNA, 375 bp, Artificial Sequence
  Description of Artificial Sequence: Synthetic polynucleotide
caggttcagctggtgcagtctggagctgaggtgaagacgcccggggcctcagtgagggtctcctgcaaggcttctggttacacctttaccaactatggtatcagctgggtgcgacaggcccctggacaagggcttgagtggatgggatggatcagcgcttacaatggttactcaaactatgcacagaagttccaggacagagtcaccatgaccacagacacatccacgagcacagcctacatggagctgaggagcctgagatctgacgacacggccgtgtattactgtgcgagagaggagaagcagctcgtcaaagactattactactacggtatggacgtctggggccaggggtccacggtcaccgtctcctca

SEQ ID NO: 591 - DNA, 366 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgagctgggtccgccagtctccagggaaggggctggagtgggtctcagttattagtggtagtggtggtgacacatactacgcagactccgtgaagggccggttcaccatctccagagacaattccaagaacacgctgtatctacaaatgaacagcctgagagccgaggatacggccgtatattactgtgcgaaagatcataccagtggctggtactactacggtatggacgtctggggccaagggaccacggtcaccgtctcctca

SEQ ID NO: 592 - DNA, 345 bp, Artificial Sequence
  Description of Artificial Sequence: Synthetic polynucleotide
caggtgcagctgcaggagtcgggcccaggactggtgaagccttcggagaccctgtccctcacctgcactgtctctgatggctccatcagtagttactactggaactggatccggcagcccgccgggaagggactggagtggattgggcgtatctataccagtgggagcaccaactacaatccctccctcaagagtcgagtcaccatgtcagtagacacgtccaagaaccagttctccctgaacctgacctctgtgaccgccgcggacacggccgtgtattactgtgcgagaggccctctttggtttgactactggggccagggaaccctggtcaccgtctcctca

SEQ ID NO: 593 - DNA, 375 bp, Artificial Sequence
  Description of Artificial Sequence: Synthetic polynucleotide
caggtccagctggtacagtctggggctgaggtgaagaagcctggggcctcagtgaaggtctcctgcaaggtttccggatacaccctcactgaattatccatacactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacacattctggttcggggaggttttactactactactacggtatggacgtctggggccaagggaccacggtcaccgtctcctca

SEQ ID NO: 594 - DNA, 360 bp, Artificial Sequence
  Description of Artificial Sequence: Synthetic polynucleotide
cagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggaccacctactacaacccgtccctcaagagtcgagtcaccatatccgtagacacgtccaagaaccagttctccctgaagctgagttctgtgaccgccgcagacacggctgtgtattactgtgcgagagtggcagcagtttactggtacttcgatctctggggccgtggcaccctggtcactgtctcctca

SEQ ID NO: 595 - DNA, 366 bp, Artificial Sequence
  Description of Artificial Sequence: Synthetic polynucleotide
caggtgcagctggtgcagtctggggctgaggtgaagaagactggggcctcagtgaaggtctcctgcaaggcttctggatacaccttcaccagtcatgatatcaactgggtgcgacaggccactggacacgggcttgagtggatgggatggatgaacccttacagtggtagcacaggcctcgcacagaggttccaggacagagtcaccatgaccaggaacacctccataagcacagcctacatggagctgagcagcctgagatctgaggacacggccgtgtattactgtgcgagagaccttagcagtggctactactactacggtttggacgtgtggggccaagggaccacggtcaccgtctcctca

SEQ ID NO: 596 - DNA, 372 bp, Artificial Sequence
  Description of Artificial Sequence: Synthetic polynucleotide
caggtgcagctggtgcagtctggggctgaggtgaagaagcctggggcctcagtgaaggtctcctgcaaggcctctggataccccttcatcggctactatatgcactgggtgcgacaggcccctggacaagggcttgagtggatgggatggatcaaccctgacagtggtggcacaaactatgcacagaagtttcagggcagggtcaccatgaccagggacacgtccatcaccacagcctacatggagctgagcaggctgagatctgacgacacggccgttttttactgtgcgagaggcggatacagctatggttacgaggactactacggtatggacgtctggggccaagggaccacggtcaccgtctcctca

SEQ ID NO: 597 - DNA, 351 bp, Artificial Sequence
  Description of Artificial Sequence: Synthetic polynucleotide
caggtgcagctacagcagtggggcgcaggactgttgaagccttcggagaccctgtccctcacttgcgctgtctatggtgggtccttcagtggttactactggagctggatccgccagcccccagggaagggtctggagtggattggggaaatcaatcatagtgaaaacaccaactacaacccgtccctcaagagtcgagtcaccatatcactagacacgtcccatgaccagttctccctaagactaacctctgtgaccgccgcggacacggctgtctattactgtgcgagagtaactggaacggatgcttttgatttctggggccaagggacaatggtcaccgtctcttca

SEQ ID NO: 598 - DNA, 351 bp, Artificial Sequence
  Description of Artificial Sequence: Synthetic polynucleotide
caggtgcagctgcaggagtcgggcccaggactggtgaagccttcacagaccctgtccctcacctgcactgtctctaatggctccatcaatagtggtaattactactggagctggatccgccagcacccaggaaagggcctggagtggattgggtacatctatcacagtgggagcgcctactacaacccgtccctcaagagtcgagttaccatatcagtggacacgtctaagaaccagttctccctaaagctgagttctgtgactgccgcggacacggccgtgtattactgtgcgagaactacgggtgcttctgatatctggggccaagggataatggtcaccgtctcttca

SEQ ID NO: 599 - DNA, 363 bp, Artificial Sequence
  Description of Artificial Sequence: Synthetic polynucleotide
caggtgcaggtagtgcagtctgggactgaggtgaagaagcctggggcctcagtgaaggtctcctgcaaggcttctggatacaccttcacaggctactatatacattgggtgcgacaggcccctggacaagggcttgagtggatgggatggatcaaccctaacagtggtggcacaaactatgcacagaagtttcggggcagggtcaccatgaccagggacacgtccatcagcacagcctacatggagctgagcaggctgagatctgacgacacggccgtgtattactgtgcgagagaggaagactacagtgaccaccactactttgactactggggccagggaaccctggtcaccgtctcctca

SEQ ID NO: 600 - DNA, 348 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccagttctccctgaggctgagctctgtgaccgctgcggacacggccgtgtattactgtgcgagagggataactggaactattgacttctggggccagggaaccctggtcaccgtctcctca

SEQ ID NO: 601 - DNA, 375 bp, Artificial Sequence
  Description of Artificial Sequence: Synthetic polynucleotide
gaagtgcagttggtggagtctgggggaggcttggtacagcctggggggtccctgagactctcctgtgcagcctctggattcaccttcagtagctatagcatgaactgggtccgccaggctccagggaaggggctggagtggatttcatacattagtagtggtagtagtaccatataccacgcagactctgtgaagggccgattcaccatttccagagacaatgccaagaactcactgtatctgcaaatgaacagcctgagagacgaggacacggctgtgtattactgtgcgagagaagggtactatgatagtagtggttattactacaacggtatggacgtctggggccaagggaccacggtcaccgtctcctca

SEQ ID NO: 602 - DNA, 366 bp, Artificial Sequence
  Description of Artificial Sequence: Synthetic polynucleotide
caggtacagctacagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaccccagacacatccaagaaccagttctccctgcagctgaagtctgtgactcccgaggacacggctatttattactgtgcaagagagggcagctggtcctccttctttgactactggggccagggaaccctggtcaccgtttcctca

SEQ ID NO: 603 - protein, 5 aa, Artificial Sequence
  Description of Artificial Sequence: Synthetic peptide
GYYWT

SEQ ID NO: 604 - protein, 5 aa, Artificial Sequence
  Description of Artificial Sequence: Synthetic peptide
GYYWS

SEQ ID NO: 605 - protein, 5 aa, Artificial Sequence
  Description of Artificial Sequence: Synthetic peptide
SYSMN

SEQ ID NO: 606 - protein, 5 aa, Artificial Sequence
  Description of Artificial Sequence: Synthetic peptide
GYYKH

SEQ ID NO: 607 - protein, 5 aa, Artificial Sequence
  Description of Artificial Sequence: Synthetic peptide
ELSIH

SEQ ID NO: 608 - protein, 5 aa, Artificial Sequence
  Description of Artificial Sequence: Synthetic peptide
NYGMH

SEQ ID NO: 609 - protein, 5 aa, Artificial Sequence
  Description of Artificial Sequence: Synthetic peptide
SYDID

SEQ ID NO: 610 - protein, 5 aa, Artificial Sequence
  Description of Artificial Sequence: Synthetic peptide
NYGMR

SEQ ID NO: 611 - protein, 7 aa, Artificial Sequence
  Description of Artificial Sequence: Synthetic peptide
NPRMGVS

SEQ ID NO: 612 - protein, 5 aa, Artificial Sequence
  Description of Artificial Sequence: Synthetic peptide
SYDIN

SEQ ID NO: 613 - protein, 5 aa, Artificial Sequence
  Description of Artificial Sequence: Synthetic peptide
SYGLH

SEQ ID NO: 614 - protein, 5 aa, Artificial Sequence
  Description of Artificial Sequence: Synthetic peptide
SYGMH

SEQ ID NO: 615 - protein, 5 aa, Artificial Sequence
  Description of Artificial Sequence: Synthetic peptide
NYAMS

SEQ ID NO: 616 - protein, 7 aa, Artificial Sequence
  Description of Artificial Sequence: Synthetic peptide
SGGYYWS

SEQ ID NO: 617 - protein, 5 aa, Artificial Sequence
  Description of Artificial Sequence: Synthetic peptide
GYYLH

SEQ ID NO: 618 - protein, 5 aa, Artificial Sequence
  Description of Artificial Sequence: Synthetic peptide
YYYWS

SEQ ID NO: 619 - protein, 5 aa, Artificial Sequence
  Description of Artificial Sequence: Synthetic peptide
GYYTH

SEQ ID NO: 620 - protein, 5 aa, Artificial Sequence
  Description of Artificial Sequence: Synthetic peptide
TYYWS

SEQ ID NO: 621 - protein, 5 aa, Artificial Sequence
  Description of Artificial Sequence: Synthetic peptide
TYGMH

SEQ ID NO: 622 - protein, 5 aa, Artificial Sequence
  Description of Artificial Sequence: Synthetic peptide
DYYWN

SEQ ID NO: 623 - protein, 5 aa, Artificial Sequence
  Description of Artificial Sequence: Synthetic peptide
SYAMS

SEQ ID NO: 624 - protein, 7 aa, Artificial Sequence
  Description of Artificial Sequence: Synthetic peptide
SGVYYWN

SEQ ID NO: 625 - protein, 5 aa, Artificial Sequence
  Description of Artificial Sequence: Synthetic peptide
SFGMH

SEQ ID NO: 626 - protein, 5 aa, Artificial Sequence
  Description of Artificial Sequence: Synthetic peptide
SYYWS

SEQ ID NO: 627 - protein, 5 aa, Artificial Sequence
  Description of Artificial Sequence: Synthetic peptide
SYWIG

SEQ ID NO: 628 - protein, 5 aa, Artificial Sequence
  Description of Artificial Sequence: Synthetic peptide
SYYWN

SEQ ID NO: 629 - protein, 7 aa, Artificial Sequence
  Description of Artificial Sequence: Synthetic peptide
SSSYYWG

SEQ ID NO: 630 - protein, 7 aa, Artificial Sequence
  Description of Artificial Sequence: Synthetic peptide
SGVYYWS

SEQ ID NO: 631 - protein, 7 aa, Artificial Sequence
  Description of Artificial Sequence: Synthetic peptide
SNSATWN

SEQ ID NO: 632 - protein, 5 aa, Artificial Sequence
  Description of Artificial Sequence: Synthetic peptide
DSYMS

SEQ ID NO: 633 - protein, 5 aa, Artificial Sequence
  Description of Artificial Sequence: Synthetic peptide
SYSMS

SEQ ID NO: 634 - protein, 5 aa, Artificial Sequence
  Description of Artificial Sequence: Synthetic peptide
HYAMS

SEQ ID NO: 635 - protein, 5 aa, Artificial Sequence
  Description of Artificial Sequence: Synthetic peptide
NYGIS

SEQ ID NO: 636 - protein, 5 aa, Artificial Sequence
  Description of Artificial Sequence: Synthetic peptide
SYGIH

SEQ ID NO: 637 - protein, 7 aa, Artificial Sequence
  Description of Artificial Sequence: Synthetic peptide
SGDYYWT

SEQ ID NO: 638 - protein, 7 aa, Artificial Sequence
  Description of Artificial Sequence: Synthetic peptide
SGDYYWS

SEQ ID NO: 639 - protein, 5 aa, Artificial Sequence
  Description of Artificial Sequence: Synthetic peptide
GYYMH

SEQ ID NO: 640 - protein, 5 aa, Artificial Sequence
  Description of Artificial Sequence: Synthetic peptide
NAWMS

SEQ ID NO: 641 - protein, 7 aa, Artificial Sequence
  Description of Artificial Sequence: Synthetic peptide
SGNYYWS

SEQ ID NO: 642 - protein, 7 aa, Artificial Sequence
  Description of Artificial Sequence: Synthetic peptide
SDTSYWG

SEQ ID NO: 643 - protein, 5 aa, Artificial Sequence
  Description of Artificial Sequence: Synthetic peptide
SHDIN

SEQ ID NO: 644 - protein, 7 aa, Artificial Sequence
  Description of Artificial Sequence: Synthetic peptide
SNSAAWN

SEQ ID NO: 645 - protein, 5 aa, Artificial Sequence
  Description of Artificial Sequence: Synthetic peptide
GYYIH

SEQ ID NO: 646 - protein, 5 aa, Artificial Sequence
  Description of Artificial Sequence: Synthetic peptide
GYFMH

SEQ ID NO: 647 - protein, 5 aa, Artificial Sequence
  Description of Artificial Sequence: Synthetic peptide
TYDMH

SEQ ID NO: 648 - protein, 5 aa, Artificial Sequence
  Description of Artificial Sequence: Synthetic peptide
SYDMH

SEQ ID NO: 649 - protein, 5 aa, Artificial Sequence
  Description of Artificial Sequence: Synthetic peptide
NYNMH

SEQ ID NO: 650 - protein, 5 aa, Artificial Sequence
  Description of Artificial Sequence: Synthetic peptide
FYGMH

SEQ ID NO: 651 - protein, 5 aa, Artificial Sequence
  Description of Artificial Sequence: Synthetic peptide
YYYIH

SEQ ID NO: 652 - protein, 7 aa, Artificial Sequence
  Description of Artificial Sequence: Synthetic peptide
SDAYYWS

SEQ ID NO: 653 - protein, 7 aa, Artificial Sequence
  Description of Artificial Sequence: Synthetic peptide
SGDNYWS

SEQ ID NO: 654 - protein, 7 aa, Artificial Sequence
  Description of Artificial Sequence: Synthetic peptide
SGGYYWN

SEQ ID NO: 655 - protein, 5 aa, Artificial Sequence
  Description of Artificial Sequence: Synthetic peptide
GYWIG

SEQ ID NO: 656 - protein, 16 aa, Artificial Sequence
  Description of Artificial Sequence: Synthetic peptide
EINHSENTNYNPSLKS

SEQ ID NO: 657 - protein, 16 aa, Artificial Sequence
  Description of Artificial Sequence: Synthetic peptide
EITHTGSSNYNPSLKS

SEQ ID NO: 658 - protein, 17 aa, Artificial Sequence
  Description of Artificial Sequence: Synthetic peptide
SISSSSSYEYYVDSVKG

SEQ ID NO: 659 - protein, 17 aa, Artificial Sequence
  Description of Artificial Sequence: Synthetic peptide
WINPNSGATKYAQKFQG

SEQ ID NO: 660 - protein, 17 aa, Artificial Sequence
  Description of Artificial Sequence: Synthetic peptide
GFDPEDGETIYAQKFQG

SEQ ID NO: 661 - protein, 17 aa, Artificial Sequence
  Description of Artificial Sequence: Synthetic peptide
IIWYDGSNKNYADSVKG

SEQ ID NO: 662 - protein, 17 aa, Artificial Sequence
  Description of Artificial Sequence: Synthetic peptide
WMNPNGGNTGYAQKFQG

SEQ ID NO: 663 - protein, 17 aa, Artificial Sequence
  Description of Artificial Sequence: Synthetic peptide
LIWYDGSNKFYADSVKG

SEQ ID NO: 664 - protein, 16 aa, Artificial Sequence
  Description of Artificial Sequence: Synthetic peptide
HIFSNDEKSYSTSLKS

SEQ ID NO: 665 - protein, 17 aa, Artificial Sequence
  Description of Artificial Sequence: Synthetic peptide
WMNPYSGSTGYAQNFQG

SEQ ID NO: 666 - protein, 17 aa, Artificial Sequence
  Description of Artificial Sequence: Synthetic peptide
VIWNDGSNKLYADSVKG

SEQ ID NO: 667 - protein, 17 aa, Artificial Sequence
  Description of Artificial Sequence: Synthetic peptide
VISYDGSNKYYADSVKG

SEQ ID NO: 668 - protein, 17 aa, Artificial Sequence
  Description of Artificial Sequence: Synthetic peptide
GISGSSAGTYYADSVKG

SEQ ID NO: 669 - protein, 16 aa, Artificial Sequence
  Description of Artificial Sequence: Synthetic peptide
YIYYNGSPYDNPSLKR

SEQ ID NO: 670 - protein, 16 aa, Artificial Sequence
  Description of Artificial Sequence: Synthetic peptide
ELDHSGSINYNPSLKS

SEQ ID NO: 671 - protein, 17 aa, Artificial Sequence
  Description of Artificial Sequence: Synthetic peptide
SISSSSTYIYYADSVKG

SEQ ID NO: 672 - protein, 17 aa, Artificial Sequence
  Description of Artificial Sequence: Synthetic peptide
WINPNSAATNYAPKFQG

SEQ ID NO: 673 - protein, 16 aa, Artificial Sequence
  Description of Artificial Sequence: Synthetic peptide
YIYYSGSTNYNPSLKS

SEQ ID NO: 674 - protein, 17 aa, Artificial Sequence
  Description of Artificial Sequence: Synthetic peptide
VIWYDGSNNYYADSVKG

SEQ ID NO: 675 - protein, 17 aa, Artificial Sequence
  Description of Artificial Sequence: Synthetic peptide
WINPSSGDTKYAQKFQG

SEQ ID NO: 676 - protein, 16 aa, Artificial Sequence
  Description of Artificial Sequence: Synthetic peptide
YIFYNGNANYSPSLKS

SEQ ID NO: 677 - protein, 17 aa, Artificial Sequence
  Description of Artificial Sequence: Synthetic peptide
VIWYDGSNKYYADSVKG

SEQ ID NO: 678 - protein, 17 aa, Artificial Sequence
  Description of Artificial Sequence: Synthetic peptide
LISYDGSNKYYADSVKG

SEQ ID NO: 679 - protein, 16 aa, Artificial Sequence
  Description of Artificial Sequence: Synthetic peptide
EINHSGTTNYNPSLKS

SEQ ID NO: 680 - protein, 17 aa, Artificial Sequence
  Description of Artificial Sequence: Synthetic peptide
WMNPHSGNTGYAQKFQG

SEQ ID NO: 681 - protein, 17 aa, Artificial Sequence
  Description of Artificial Sequence: Synthetic peptide
AISGSGRTTYSADSVKG

SEQ ID NO: 682 - protein, 16 aa, Artificial Sequence
  Description of Artificial Sequence: Synthetic peptide
YLYYSGSTYYNPSLKS

SEQ ID NO: 683 - protein, 17 aa, Artificial Sequence
  Description of Artificial Sequence: Synthetic peptide
LIWYDGDNKYYADSVKG

SEQ ID NO: 684 - protein, 16 aa, Artificial Sequence
  Description of Artificial Sequence: Synthetic peptide
RIYISGSTNYNPSLEN

SEQ ID NO: 685 - protein, 17 aa, Artificial Sequence
  Description of Artificial Sequence: Synthetic peptide
VIWYDGSYQFYADSVKG

SEQ ID NO: 686 - protein, 17 aa, Artificial Sequence
  Description of Artificial Sequence: Synthetic peptide
IIYPGDSDTRYSPSFQG

SEQ ID NO: 687 - protein, 16 aa, Artificial Sequence
  Description of Artificial Sequence: Synthetic peptide
RIYTSGSTNYNPSLKS

SEQ ID NO: 688 - protein, 16 aa, Artificial Sequence
  Description of Artificial Sequence: Synthetic peptide
MIYYSGTTYYNPSLKS

SEQ ID NO: 689 - protein, 16 aa, Artificial Sequence
  Description of Artificial Sequence: Synthetic peptide
YIYYSGSTYYNPSLKS

SEQ ID NO: 690 - protein, 18 aa, Artificial Sequence
  Description of Artificial Sequence: Synthetic peptide
RTYYRSKWYNDYAVSVKS

SEQ ID NO: 691 - protein, 17 aa, Artificial Sequence
  Description of Artificial Sequence: Synthetic peptide
VIWNDGNNKYYADSVKG

SEQ ID NO: 692 - protein, 17 aa, Artificial Sequence
  Description of Artificial Sequence: Synthetic peptide
SISSSGSIVYFADSVKG

SEQ ID NO: 693 - protein, 17 aa, Artificial Sequence
  Description of Artificial Sequence: Synthetic peptide
SISSSSTYIYYADSLKG

SEQ ID NO: 694 - protein, 17 aa, Artificial Sequence
  Description of Artificial Sequence: Synthetic peptide
ITSYGGSNKNYADSVKG

SEQ ID NO: 695 - protein, 17 aa, Artificial Sequence
  Description of Artificial Sequence: Synthetic peptide
AISGSGAGTFYADSMKG

SEQ ID NO: 696 - protein, 17 aa, Artificial Sequence
  Description of Artificial Sequence: Synthetic peptide
VISDSGGSTYYADSVKG

SEQ ID NO: 697 - protein, 17 aa, Artificial Sequence
  Description of Artificial Sequence: Synthetic peptide
WISAYNGYSNYAQKFQD

SEQ ID NO: 698 - protein, 17 aa, Artificial Sequence
  Description of Artificial Sequence: Synthetic peptide
VISGSGGDTYYADSVKG

SEQ ID NO: 699 - protein, 16 aa, Artificial Sequence
  Description of Artificial Sequence: Synthetic peptide
YIYYTGSTYYNPSLKS

SEQ ID NO: 700 - protein, 16 aa, Artificial Sequence
  Description of Artificial Sequence: Synthetic peptide
YIYYSGTTYYNPSLKS

SEQ ID NO: 701 - protein, 16 aa, Artificial Sequence
  Description of Artificial Sequence: Synthetic peptide
YIYYTGSTNYNPSLKS

SEQ ID NO: 702 - protein, 17 aa, Artificial Sequence
  Description of Artificial Sequence: Synthetic peptide
WMNPNSGATKYAQKFQG

SEQ ID NO: 703 - protein, 17 aa, Artificial Sequence
  Description of Artificial Sequence: Synthetic peptide
VIWDDGSNKYYADSVKG

SEQ ID NO: 704 - protein, 19 aa, Artificial Sequence
  Description of Artificial Sequence: Synthetic peptide
RIKSKTDGGTTEYAAPVKG

SEQ ID NO: 705 - protein, 16 aa, Artificial Sequence
  Description of Artificial Sequence: Synthetic peptide
YIYYSGSAYYNPSLKS

SEQ ID NO: 706 - protein, 16 aa, Artificial Sequence
  Description of Artificial Sequence: Synthetic peptide
NIYYSGTTYFNPSLKS

SEQ ID NO: 707 - protein, 16 aa, Artificial Sequence
  Description of Artificial Sequence: Synthetic peptide
YIFYSGSTYYNPSLKS

SEQ ID NO: 708 - protein, 17 aa, Artificial Sequence
  Description of Artificial Sequence: Synthetic peptide
WINPNSGGTDYAQKFQG

SEQ ID NO: 709 - protein, 17 aa, Artificial Sequence
  Description of Artificial Sequence: Synthetic peptide
GISYDGSNKNYADSVKG

SEQ ID NO: 710 - protein, 17 aa, Artificial Sequence
  Description of Artificial Sequence: Synthetic peptide
VIWYDGSNKYHADSVKG

SEQ ID NO: 711 - protein, 17 aa, Artificial Sequence
  Description of Artificial Sequence: Synthetic peptide
WINPPSGATNYAQKFRG

SEQ ID NO: 712 - protein, 17 aa, Artificial Sequence
  Description of Artificial Sequence: Synthetic peptide
WINPNSGATNYAQKFHG

SEQ ID NO: 713 - protein, 16 aa, Artificial Sequence
  Description of Artificial Sequence: Synthetic peptide
AIGIAGDTYYSDSVKG

SEQ ID NO: 714 - protein, 16 aa, Artificial Sequence
  Description of Artificial Sequence: Synthetic peptide
TIDTAGDAYYPGSVKG

SEQ ID NO: 715 - protein, 19 aa, Artificial Sequence
  Description of Artificial Sequence: Synthetic peptide
RIKSKTDGGTTDYAAPVKG

SEQ ID NO: 716 - protein, 19 aa, Artificial Sequence
  Description of Artificial Sequence: Synthetic peptide
RIIGKTDGGTTDYAAPVKG

SEQ ID NO: 717 - protein, 17 aa, Artificial Sequence
  Description of Artificial Sequence: Synthetic peptide
VISYDGSNKHYADSVKG

SEQ ID NO: 718 - protein, 17 aa, Artificial Sequence
  Description of Artificial Sequence: Synthetic peptide
VLWYDGNTKYYADSVKG

SEQ ID NO: 719 - protein, 17 aa, Artificial Sequence
  Description of Artificial Sequence: Synthetic peptide
LIWYDGSNKDYADSVKG

SEQ ID NO: 720 - protein, 17 aa, Artificial Sequence
  Description of Artificial Sequence: Synthetic peptide
VIWYDGSNKDYADSVKG

SEQ ID NO: 721 - protein, 16 aa, Artificial Sequence
  Description of Artificial Sequence: Synthetic peptide
YIYYSGGTHYNPSLKS

SEQ ID NO: 722 - protein, 16 aa, Artificial Sequence
  Description of Artificial Sequence: Synthetic peptide
YIYYSGNTNYNPSLKS

SEQ ID NO: 723 - protein, 16 aa, Artificial Sequence
  Description of Artificial Sequence: Synthetic peptide
FIYYSGGTNYNPSLKS

SEQ ID NO: 724 - protein, 16 aa, Artificial Sequence
  Description of Artificial Sequence: Synthetic peptide
FMFYSGSTNYNPSLKS

SEQ ID NO: 725 - protein, 17 aa, Artificial Sequence
  Description of Artificial Sequence: Synthetic peptide
IIYPGDSETRYSPSFQG

SEQ ID NO: 726 - protein, 16 aa, Artificial Sequence
  Description of Artificial Sequence: Synthetic peptide
YIYDSGSTYYNPSLKS

SEQ ID NO: 727 - protein, 16 aa, Artificial Sequence
  Description of Artificial Sequence: Synthetic peptide
SIYYSGTTYYNPSLKS

SEQ ID NO: 728 - protein, 17 aa, Artificial Sequence
  Description of Artificial Sequence: Synthetic peptide
WINPDSGGTNYAQKFQG

SEQ ID NO: 729 - protein, 17 aa, Artificial Sequence
  Description of Artificial Sequence: Synthetic peptide
WINPNSGGTNYAQKFRG

SEQ ID NO: 730 - protein, 17 aa, Artificial Sequence
  Description of Artificial Sequence: Synthetic peptide
WMNPYSGSTGLAQRFQD

SEQ ID NO: 731 - protein, 17 aa, Artificial Sequence
  Description of Artificial Sequence: Synthetic peptide
YISSGSSTIYHADSVKG

SEQ ID NO: 732 - protein, 16 aa, Artificial Sequence
  Description of Artificial Sequence: Synthetic peptide
YIYHSGSAYYNPSLKS

SEQ ID NO: 733 - protein, 9 aa, Artificial Sequence
  Description of Artificial Sequence: Synthetic peptide
ESGNFPFDY

SEQ ID NO: 734 - protein, 13 aa, Artificial Sequence
  Description of Artificial Sequence: Synthetic peptide
GGILWFGEQAFDI

SEQ ID NO: 735 - protein, 11 aa, Artificial Sequence
  Description of Artificial Sequence: Synthetic peptide
SLSIAVAASDY

SEQ ID NO: 736 - protein, 16 aa, Artificial Sequence
  Description of Artificial Sequence: Synthetic peptide
EVPDGIVVAGSNAFDF

SEQ ID NO: 737 - protein, 16 aa, Artificial Sequence
  Description of Artificial Sequence: Synthetic peptide
HSGSGRFYYYYYGMDV

SEQ ID NO: 738 - protein, 20 aa, Artificial Sequence
  Description of Artificial Sequence: Synthetic peptide
DQDYDFWSGYPYFYYYGMDV

SEQ ID NO: 739 - protein, 11 aa, Artificial Sequence
  Description of Artificial Sequence: Synthetic peptide
GKEFSRAEFDY

SEQ ID NO: 740 - protein, 20 aa, Artificial Sequence
  Description of Artificial Sequence: Synthetic peptide
DRYYDFWSGYPYFFYYGLDV

SEQ ID NO: 741 - protein, 13 aa, Artificial Sequence
  Description of Artificial Sequence: Synthetic peptide
VDTLNYHYYGMDV

SEQ ID NO: 742 - protein, 10 aa, Artificial Sequence
  Description of Artificial Sequence: Synthetic peptide
YNWNYGAFDF

SEQ ID NO: 743 - protein, 20 aa, Artificial Sequence
  Description of Artificial Sequence: Synthetic peptide
DQYYDFWSGYPYYHYYGMDV

SEQ ID NO: 744 - protein, 16 aa, Artificial Sequence
  Description of Artificial Sequence: Synthetic peptide
ADGDYPYYYYYYGMDV

SEQ ID NO: 745 - protein, 12 aa, Artificial Sequence
  Description of Artificial Sequence: Synthetic peptide
DWSIAVAGTFDY

SEQ ID NO: 746 - protein, 8 aa, Artificial Sequence
  Description of Artificial Sequence: Synthetic peptide
GALYGMDV

SEQ ID NO: 747 - protein, 8 aa, Artificial Sequence
  Description of Artificial Sequence: Synthetic peptide
VLGSTLDY

SEQ ID NO: 748 - protein, 13 aa, Artificial Sequence
  Description of Artificial Sequence: Synthetic peptide
DTYISGWNYGMDV

SEQ ID NO: 749 - protein, 10 aa, Artificial Sequence
  Description of Artificial Sequence: Synthetic peptide
EGGTYNWFDP

SEQ ID NO: 750 - protein, 7 aa, Artificial Sequence
  Description of Artificial Sequence: Synthetic peptide
GTRAFDI

SEQ ID NO: 751 - protein, 11 aa, Artificial Sequence
  Description of Artificial Sequence: Synthetic peptide
DRAGASPGMDV

SEQ ID NO: 752 - protein, 9 aa, Artificial Sequence
  Description of Artificial Sequence: Synthetic peptide
VTGTDAFDF

SEQ ID NO: 753 - protein, 13 aa, Artificial Sequence
  Description of Artificial Sequence: Synthetic peptide
SGWYPSYYYGMDV

SEQ ID NO: 754 - protein, 13 aa, Artificial Sequence
  Description of Artificial Sequence: Synthetic peptide
ETDYGDYARPFEY

SEQ ID NO: 755 - protein, 11 aa, Artificial Sequence
  Description of Artificial Sequence: Synthetic peptide
GHYDSSGPRDY

SEQ ID NO: 756 - protein, 13 aa, Artificial Sequence
  Description of Artificial Sequence: Synthetic peptide
EANWGYNYYGMDV

SEQ ID NO: 757 - protein, 14 aa, Artificial Sequence
  Description of Artificial Sequence: Synthetic peptide
ILRYFDWLEYYFDY

SEQ ID NO: 758 - protein, 10 aa, Artificial Sequence
  Description of Artificial Sequence: Synthetic peptide
EGSWSSFFDY

SEQ ID NO: 759 - protein, 10 aa, Artificial Sequence
  Description of Artificial Sequence: Synthetic peptide
EQQWLVYFDY

SEQ ID NO: 760 - protein, 17 aa, Artificial Sequence
  Description of Artificial Sequence: Synthetic peptide
DGITMVRGVTHYYGMDV

SEQ ID NO: 761 - protein, 16 aa, Artificial Sequence
  Description of Artificial Sequence: Synthetic peptide
EGYYDSSGYYYNGMDV

SEQ ID NO: 762 - protein, 14 aa, Artificial Sequence
  Description of Artificial Sequence: Synthetic peptide
NSGWDYFYYYGMDV

SEQ ID NO: 763 - protein, 8 aa, Artificial Sequence
  Description of Artificial Sequence: Synthetic peptide
SGSYSFDY

SEQ ID NO: 764 - protein, 13 aa, Artificial Sequence
  Description of Artificial Sequence: Synthetic peptide
DIYSSGWSYGMDV

SEQ ID NO: 765 - protein, 13 aa, Artificial Sequence
  Description of Artificial Sequence: Synthetic peptide
DHVWRTYRYIFDY

SEQ ID NO: 766 - protein, 8 aa, Artificial Sequence
  Description of Artificial Sequence: Synthetic peptide
AQLGIFDY

SEQ ID NO: 767 - protein, 15 aa, Artificial Sequence
  Description of Artificial Sequence: Synthetic peptide
GGYSYGYEDYYGMDV

SEQ ID NO: 768 - protein, 7 aa, Artificial Sequence
  Description of Artificial Sequence: Synthetic peptide
GPLWFDY

SEQ ID NO: 769 - protein, 10 aa, Artificial Sequence
  Description of Artificial Sequence: Synthetic peptide
VAAVYWYFDL

SEQ ID NO: 770 - protein, 8 aa, Artificial Sequence
  Description of Artificial Sequence: Synthetic peptide
GITGTIDF

SEQ ID NO: 771 - protein, 11 aa, Artificial Sequence
  Description of Artificial Sequence: Synthetic peptide
IVVVPAVLFDY

SEQ ID NO: 772 - protein, 20 aa, Artificial Sequence
  Description of Artificial Sequence: Synthetic peptide
DQNYDFWNGYPYYFYYGMDV

SEQ ID NO: 773 - protein, 13 aa, Artificial Sequence
  Description of Artificial Sequence: Synthetic peptide
ETFSSGWFDAFDI

SEQ ID NO: 774 - protein, 13 aa, Artificial Sequence
  Description of Artificial Sequence: Synthetic peptide
DRWSSGWNEGFDY

SEQ ID NO: 775 - protein, 7 aa, Artificial Sequence
  Description of Artificial Sequence: Synthetic peptide
TTGASDI

SEQ ID NO: 776 - protein, 8 aa, Artificial Sequence
  Description of Artificial Sequence: Synthetic peptide
EAGYSFDY

SEQ ID NO: 777 - protein, 12 aa, Artificial Sequence
  Description of Artificial Sequence: Synthetic peptide
DLRIAVAGSFDY

SEQ ID NO: 778 - protein, 20 aa, Artificial Sequence
  Description of Artificial Sequence: Synthetic peptide
DQYFDFWSGYPFFYYYGMDV

SEQ ID NO: 779 - protein, 13 aa, Artificial Sequence
  Description of Artificial Sequence: Synthetic peptide
DHSSGWYYYGMDV

SEQ ID NO: 780 - protein, 16 aa, Artificial Sequence
  Description of Artificial Sequence: Synthetic peptide
EEKQLVKDYYYYGMDV

SEQ ID NO: 781 - protein, 13 aa, Artificial Sequence
  Description of Artificial Sequence: Synthetic peptide
DHTSGWYYYGMDV

SEQ ID NO: 782 - protein, 14 aa, Artificial Sequence
  Description of Artificial Sequence: Synthetic peptide
TVTKEDYYYYGMDV

SEQ ID NO: 783 - protein, 10 aa, Artificial Sequence
  Description of Artificial Sequence: Synthetic peptide
MTTPYWYFDL

SEQ ID NO: 784 - protein, 10 aa, Artificial Sequence
  Description of Artificial Sequence: Synthetic peptide
MTTPYWYFGL

SEQ ID NO: 785 - protein, 11 aa, Artificial Sequence
  Description of Artificial Sequence: Synthetic peptide
EYYYGSGSYYP

SEQ ID NO: 786 - protein, 10 aa, Artificial Sequence
  Description of Artificial Sequence: Synthetic peptide
ELGDYPFFDY

SEQ ID NO: 787 - protein, 10 aa, Artificial Sequence
  Description of Artificial Sequence: Synthetic peptide
EYVAEAGFDY

SEQ ID NO: 788 - protein, 14 aa, Artificial Sequence
  Description of Artificial Sequence: Synthetic peptide
DSSGSYYVEDYFDY

SEQ ID NO: 789 - protein, 10 aa, Artificial Sequence
  Description of Artificial Sequence: Synthetic peptide
LRGVYWYFDL

SEQ ID NO: 790 - protein, 10 aa, Artificial Sequence
  Description of Artificial Sequence: Synthetic peptide
MTSPYWYFDL

SEQ ID NO: 791 - protein, 11 aa, Artificial Sequence
  Description of Artificial Sequence: Synthetic peptide
DAATGRYYFDN

SEQ ID NO: 792 - protein, 11 aa, Artificial Sequence
  Description of Artificial Sequence: Synthetic peptide
DPGYSYGHFDY

SEQ ID NO: 793 - protein, 10 aa, Artificial Sequence
  Description of Artificial Sequence: Synthetic peptide
ETGTWSFFDY

SEQ ID NO: 794 - protein, 10 aa, Artificial Sequence
  Description of Artificial Sequence: Synthetic peptide
ELGIFNWFDP

SEQ ID NO: 795 - protein, 15 aa, Artificial Sequence
  Description of Artificial Sequence: Synthetic peptide
DRSSGRFGDYYGMDV

SEQ ID NO: 796 - protein, 15 aa, Artificial Sequence
  Description of Artificial Sequence: Synthetic peptide
DRSSGRFGDFYGMDV

SEQ ID NO: 797 - protein, 16 aa, Artificial Sequence
  Description of Artificial Sequence: Synthetic peptide
ELLWFGEYGVDHGMDV

SEQ ID NO: 798 - protein, 9 aa, Artificial Sequence
  Description of Artificial Sequence: Synthetic peptide
DVYGDYFAY

SEQ ID NO: 799 - protein, 9 aa, Artificial Sequence
  Description of Artificial Sequence: Synthetic peptide
ALNWNFFDY

SEQ ID NO: 800 - protein, 10 aa, Artificial Sequence
  Description of Artificial Sequence: Synthetic peptide
EGTTRRGFDY

SEQ ID NO: 801 - protein, 11 aa, Artificial Sequence
  Description of Artificial Sequence: Synthetic peptide
SAVALYNWFDP

SEQ ID NO: 802 - protein, 13 aa, Artificial Sequence
  Description of Artificial Sequence: Synthetic peptide
ESRILYFNGYFQH

SEQ ID NO: 803 - protein, 16 aa, Artificial Sequence
  Description of Artificial Sequence: Synthetic peptide
VLHYSDSRGYSYYSDF

SEQ ID NO: 804 - protein, 16 aa, Artificial Sequence
  Description of Artificial Sequence: Synthetic peptide
VLHYYDSSGYSYYFDY

SEQ ID NO: 805 - protein, 13 aa, Artificial Sequence
  Description of Artificial Sequence: Synthetic peptide
YSSTWDYYYGVDV

SEQ ID NO: 806 - protein, 13 aa, Artificial Sequence
  Description of Artificial Sequence: Synthetic peptide
YRSDWDYYYGMDV

SEQ ID NO: 807 - protein, 14 aa, Artificial Sequence
  Description of Artificial Sequence: Synthetic peptide
RASRGYRFGLAFAI

SEQ ID NO: 808 - protein, 14 aa, Artificial Sequence
  Description of Artificial Sequence: Synthetic peptide
RASRGYRYGLAFAI

SEQ ID NO: 809 - protein, 11 aa, Artificial Sequence
  Description of Artificial Sequence: Synthetic peptide
VAVSAFNWFDP

SEQ ID NO: 810 - protein, 18 aa, Artificial Sequence
  Description of Artificial Sequence: Synthetic peptide
DVLMVYTKGGYYYYGVDV

SEQ ID NO: 811 - protein, 14 aa, Artificial Sequence
  Description of Artificial Sequence: Synthetic peptide
RASRGYSYGHAFDF

SEQ ID NO: 812 - protein, 13 aa, Artificial Sequence
  Description of Artificial Sequence: Synthetic peptide
DLSSGYYYYGLDV

SEQ ID NO: 813 - protein, 12 aa, Artificial Sequence
  Description of Artificial Sequence: Synthetic peptide
EEDYSDHHYFDY

SEQ ID NO: 814 - protein, 11 aa, Artificial Sequence
  Description of Artificial Sequence: Synthetic peptide
RASQNIRTYLN

SEQ ID NO: 815 - protein, 11 aa, Artificial Sequence
  Description of Artificial Sequence: Synthetic peptide
RASQRISSYLN

SEQ ID NO: 816 - protein, 11 aa, Artificial Sequence
  Description of Artificial Sequence: Synthetic peptide
RASQDIGNSLH

SEQ ID NO: 817 - protein, 11 aa, Artificial Sequence
  Description of Artificial Sequence: Synthetic peptide
RASQNIRSYLN

SEQ ID NO: 818 - protein, 17 aa, Artificial Sequence
  Description of Artificial Sequence: Synthetic peptide
RSSQSLLDSDDGNTYLD

SEQ ID NO: 819 - protein, 11 aa, Artificial Sequence
  Description of Artificial Sequence: Synthetic peptide
QASQDINIYLN

SEQ ID NO: 820 - protein, 17 aa, Artificial Sequence
  Description of Artificial Sequence: Synthetic peptide
RSSQSLLDSDDGDTYLD

SEQ ID NO: 821 - protein, 11 aa, Artificial Sequence
  Description of Artificial Sequence: Synthetic peptide
QASQGISNYLN

SEQ ID NO: 822 - protein, 11 aa, Artificial Sequence
  Description of Artificial Sequence: Synthetic peptide
QASQDITKYLN

SEQ ID NO: 823 - protein, 13 aa, Artificial Sequence
  Description of Artificial Sequence: Synthetic peptide
TRSSGSIASDYVQ

SEQ ID NO: 824 - protein, 11 aa, Artificial Sequence
  Description of Artificial Sequence: Synthetic peptide
SGDALPKKYAY

SEQ ID NO: 825 - protein, 11 aa, Artificial Sequence
  Description of Artificial Sequence: Synthetic peptide
SGDELGDKYAC

SEQ ID NO: 826 - protein, 11 aa, Artificial Sequence
  Description of Artificial Sequence: Synthetic peptide
RASQDIRNDLG

SEQ ID NO: 827 - protein, 11 aa, Artificial Sequence
  Description of Artificial Sequence: Synthetic peptide
RASQGISSWLA

SEQ ID NO: 828 - protein, 11 aa, Artificial Sequence
  Description of Artificial Sequence: Synthetic peptide
RASQTISSYLN

SEQ ID NO: 829 - protein, 11 aa, Artificial Sequence
  Description of Artificial Sequence: Synthetic peptide
RASQSVSDILA

SEQ ID NO: 830 - protein, 13 aa, Artificial Sequence
  Description of Artificial Sequence: Synthetic peptide
SGSSSNIGINYVS

SEQ ID NO: 831 - protein, 11 aa, Artificial Sequence
  Description of Artificial Sequence: Synthetic peptide
RASQSISNYLN

SEQ ID NO: 832 - protein, 16 aa, Artificial Sequence
  Description of Artificial Sequence: Synthetic peptide
RSSQSLLHSNGYNYLD

SEQ ID NO: 833 - protein, 12 aa, Artificial Sequence
  Description of Artificial Sequence: Synthetic peptide
RASQSVRSSYLA

SEQ ID NO: 834 - protein, 16 aa, Artificial Sequence
  Description of Artificial Sequence: Synthetic peptide
RSSQSLQHSNGYNYLD

SEQ ID NO: 835 - protein, 11 aa, Artificial Sequence
  Description of Artificial Sequence: Synthetic peptide
RASQGIRNDLG

SEQ ID NO: 836 - protein, 11 aa, Artificial Sequence
  Description of Artificial Sequence: Synthetic peptide
RASQSVSSNVA

SEQ ID NO: 837 - protein, 11 aa, Artificial Sequence
  Description of Artificial Sequence: Synthetic peptide
QASQDISIYLN

SEQ ID NO: 838 - protein, 12 aa, Artificial Sequence
  Description of Artificial Sequence: Synthetic peptide
RASQSFSSSYLA

SEQ ID NO: 839 - protein, 11 aa, Artificial Sequence
  Description of Artificial Sequence: Synthetic peptide
RASQDISNYLA

SEQ ID NO: 840 - protein, 16 aa, Artificial Sequence
  Description of Artificial Sequence: Synthetic peptide
RSSQSLLHSNGFNYLD

SEQ ID NO: 841 - protein, 11 aa, Artificial Sequence
  Description of Artificial Sequence: Synthetic peptide
SGDNLGDKYAF

SEQ ID NO: 842 - protein, 11 aa, Artificial Sequence
  Description of Artificial Sequence: Synthetic peptide
RASQDISSWLA

SEQ ID NO: 843 - protein, 11 aa, Artificial Sequence
  Description of Artificial Sequence: Synthetic peptide
GGNDIGSKSVH

SEQ ID NO: 844 - protein, 11 aa, Artificial Sequence
  Description of Artificial Sequence: Synthetic peptide
QASQDIKKFLN

SEQ ID NO: 845 - protein, 11 aa, Artificial Sequence
  Description of Artificial Sequence: Synthetic peptide
RARQSVGSNLI

SEQ ID NO: 846 - protein, 12 aa, Artificial Sequence
  Description of Artificial Sequence: Synthetic peptide
RASQSVSRDYLA

SEQ ID NO: 847 - protein, 11 aa, Artificial Sequence
  Description of Artificial Sequence: Synthetic peptide
RASHDISNYLA

SEQ ID NO: 848 - protein, 12 aa, Artificial Sequence
  Description of Artificial Sequence: Synthetic peptide
RASPSVSSSYLA

SEQ ID NO: 849 - protein, 11 aa, Artificial Sequence
  Description of Artificial Sequence: Synthetic peptide
RASQSISSNLA

SEQ ID NO: 850 - protein, 11 aa, Artificial Sequence
  Description of Artificial Sequence: Synthetic peptide
RASQDIDSWLV

SEQ ID NO: 851 - protein, 11 aa, Artificial Sequence
  Description of Artificial Sequence: Synthetic peptide
SGDAVPKKYAN

SEQ ID NO: 852 - protein, 11 aa, Artificial Sequence
  Description of Artificial Sequence: Synthetic peptide
SGDKLGDKYVC

SEQ ID NO: 853 - protein, 11 aa, Artificial Sequence
  Description of Artificial Sequence: Synthetic peptide
SGDNLGDKYAC

SEQ ID NO: 854 - protein, 13 aa, Artificial Sequence
  Description of Artificial Sequence: Synthetic peptide
SGSSSNIGDNYVS

SEQ ID NO: 855 - protein, 11 aa, Artificial Sequence
  Description of Artificial Sequence: Synthetic peptide
RASQTISIYLN

SEQ ID NO: 856 - protein, 12 aa, Artificial Sequence
  Description of Artificial Sequence: Synthetic peptide
RASQRVPSSYIV

SEQ ID NO: 857 - protein, 11 aa, Artificial Sequence
  Description of Artificial Sequence: Synthetic peptide
SGNKLGDKYVC

SEQ ID NO: 858 - protein, 12 aa, Artificial Sequence
  Description of Artificial Sequence: Synthetic peptide
RASQRVPSSYLV

SEQ ID NO: 859 - protein, 12 aa, Artificial Sequence
  Description of Artificial Sequence: Synthetic peptide
RASQSVRNSYLA

SEQ ID NO: 860 - protein, 12 aa, Artificial Sequence
  Description of Artificial Sequence: Synthetic peptide
RASQSVSNSYLA

SEQ ID NO: 861 - protein, 11 aa, Artificial Sequence
  Description of Artificial Sequence: Synthetic peptide
RASQSVSSQLA

SEQ ID NO: 862 - protein, 11 aa, Artificial Sequence
  Description of Artificial Sequence: Synthetic peptide
RTSQSISSYLN

SEQ ID NO: 863 - protein, 11 aa, Artificial Sequence
  Description of Artificial Sequence: Synthetic peptide
RTSQSISNYLN

SEQ ID NO: 864 - protein, 11 aa, Artificial Sequence
  Description of Artificial Sequence: Synthetic peptide
GGNNIGSKNVH

SEQ ID NO: 865 - protein, 11 aa, Artificial Sequence
  Description of Artificial Sequence: Synthetic peptide
GGNNIGSKAVH

SEQ ID NO: 866 - protein, 11 aa, Artificial Sequence
  Description of Artificial Sequence: Synthetic peptide
SGDKLGDKYAC

SEQ ID NO: 867 - protein, 12 aa, Artificial Sequence
  Description of Artificial Sequence: Synthetic peptide
RASQTVRNNYLA

SEQ ID NO: 868 - protein, 12 aa, Artificial Sequence
  Description of Artificial Sequence: Synthetic peptide
RASQSVSRNYLA

SEQ ID NO: 869 - protein, 12 aa, Artificial Sequence
  Description of Artificial Sequence: Synthetic peptide
RASQTIRNSYLA

SEQ ID NO: 870 - protein, 11 aa, Artificial Sequence
  Description of Artificial Sequence: Synthetic peptide
RASQGISRWLA

SEQ ID NO: 871 - protein, 11 aa, Artificial Sequence
  Description of Artificial Sequence: Synthetic peptide
RASQSISSYLN

SEQ ID NO: 872 - protein, 11 aa, Artificial Sequence
  Description of Artificial Sequence: Synthetic peptide
GGNNIGSINVH

SEQ ID NO: 873 - protein, 11 aa, Artificial Sequence
  Description of Artificial Sequence: Synthetic peptide
RASQIISRYLN

SEQ ID NO: 874 - protein, 11 aa, Artificial Sequence
  Description of Artificial Sequence: Synthetic peptide
RASQNINNYLN

SEQ ID NO: 875 - protein, 11 aa, Artificial Sequence
  Description of Artificial Sequence: Synthetic peptide
GGNNIGSKSVH

SEQ ID NO: 876 - protein, 11 aa, Artificial Sequence
  Description of Artificial Sequence: Synthetic peptide
GGNNIGSKSVQ

SEQ ID NO: 877 - protein, 12 aa, Artificial Sequence
  Description of Artificial Sequence: Synthetic peptide
RASQSVSRSHLA

SEQ ID NO: 878 - protein, 11 aa, Artificial Sequence
  Description of Artificial Sequence: Synthetic peptide
GGNNIGSKTVH

SEQ ID NO: 879 - protein, 16 aa, Artificial Sequence
  Description of Artificial Sequence: Synthetic peptide
RSSPSLVYSDGNTYLN

SEQ ID NO: 880 - protein, 11 aa, Artificial Sequence
  Description of Artificial Sequence: Synthetic peptide
GGNDIGSKNVH

SEQ ID NO: 881 - protein, 11 aa, Artificial Sequence
  Description of Artificial Sequence: Synthetic peptide
RASQSIGTFLN

SEQ ID NO: 882 - protein, 11 aa, Artificial Sequence
  Description of Artificial Sequence: Synthetic peptide
GGNNIGSYNVF

SEQ ID NO: 883 - protein, 12 aa, Artificial Sequence
  Description of Artificial Sequence: Synthetic peptide
RASQSVSSMYLA

SEQ ID NO: 884 - protein, 11 aa, Artificial Sequence
  Description of Artificial Sequence: Synthetic peptide
RASQSVNSNLA

SEQ ID NO: 885 - protein, 11 aa, Artificial Sequence
  Description of Artificial Sequence: Synthetic peptide
RASQSVSSNLA

SEQ ID NO: 886 - protein, 13 aa, Artificial Sequence
  Description of Artificial Sequence: Synthetic peptide
SGSSSNIGNNYVA

SEQ ID NO: 887 - protein, 13 aa, Artificial Sequence
  Description of Artificial Sequence: Synthetic peptide
SGSSSNIGNNYVS

SEQ ID NO: 888 - protein, 17 aa, Artificial Sequence
  Description of Artificial Sequence: Synthetic peptide
RSSQSLLNSDDGNTYLD

SEQ ID NO: 889 - protein, 11 aa, Artificial Sequence
  Description of Artificial Sequence: Synthetic peptide
RASQDIRNDLA

SEQ ID NO: 890 - protein, 17 aa, Artificial Sequence
  Description of Artificial Sequence: Synthetic peptide
RSSQSLLNSDAGTTYLD

SEQ ID NO: 891 - protein, 16 aa, Artificial Sequence
  Description of Artificial Sequence: Synthetic peptide
RSSQRLVYSDGNTYLN

SEQ ID NO: 892 - protein, 12 aa, Artificial Sequence
  Description of Artificial Sequence: Synthetic peptide
RASQSVASSYLV

SEQ ID NO: 893 - protein, 17 aa, Artificial Sequence
  Description of Artificial Sequence: Synthetic peptide
RSSQSLFDNDDGDTYLD

SEQ ID NO: 894 - protein, 7 aa, Artificial Sequence
  Description of Artificial Sequence: Synthetic peptide
VASSLES

SEQ ID NO: 895 - protein, 7 aa, Artificial Sequence
  Description of Artificial Sequence: Synthetic peptide
AVSSLQS

SEQ ID NO: 896 - protein, 7 aa, Artificial Sequence
  Description of Artificial Sequence: Synthetic peptide
FASQSFS

SEQ ID NO: 897 - protein, 7 aa, Artificial Sequence
  Description of Artificial Sequence: Synthetic peptide
GASNLQS

SEQ ID NO: 898 - protein, 7 aa, Artificial Sequence
  Description of Artificial Sequence: Synthetic peptide
TLSYRAS

SEQ ID NO: 899 - protein, 7 aa, Artificial Sequence
  Description of Artificial Sequence: Synthetic peptide
DVSNLET

SEQ ID NO: 900 - protein, 7 aa, Artificial Sequence
  Description of Artificial Sequence: Synthetic peptide
DASNLET

SEQ ID NO: 901 - protein, 7 aa, Artificial Sequence
  Description of Artificial Sequence: Synthetic peptide
DTFILET

SEQ ID NO: 902 - protein, 7 aa, Artificial Sequence
  Description of Artificial Sequence: Synthetic peptide
EDKERSS

SEQ ID NO: 903 - protein, 7 aa, Artificial Sequence
  Description of Artificial Sequence: Synthetic peptide
EDSKRPS

SEQ ID NO: 904 - protein, 7 aa, Artificial Sequence
  Description of Artificial Sequence: Synthetic peptide
QDTKRPS

SEQ ID NO: 905 - protein, 7 aa, Artificial Sequence
  Description of Artificial Sequence: Synthetic peptide
AASSLQF

SEQ ID NO: 906 - protein, 7 aa, Artificial Sequence
  Description of Artificial Sequence: Synthetic peptide
DASSLQS

SEQ ID NO: 907 - protein, 7 aa, Artificial Sequence
  Description of Artificial Sequence: Synthetic peptide
AASSLQS

SEQ ID NO: 908 - protein, 7 aa, Artificial Sequence
  Description of Artificial Sequence: Synthetic peptide
GASTRAT

SEQ ID NO: 909 - protein, 7 aa, Artificial Sequence
  Description of Artificial Sequence: Synthetic peptide
DNNKRPS

SEQ ID NO: 910 - protein, 7 aa, Artificial Sequence
  Description of Artificial Sequence: Synthetic peptide
LGSNRAS

SEQ ID NO: 911 - protein, 7 aa, Artificial Sequence
  Description of Artificial Sequence: Synthetic peptide
GASRRAT

SEQ ID NO: 912 - protein, 7 aa, Artificial Sequence
  Description of Artificial Sequence: Synthetic peptide
LDSNRAS

SEQ ID NO: 913 - protein, 7 aa, Artificial Sequence
  Description of Artificial Sequence: Synthetic peptide
GASSRAT

SEQ ID NO: 914 - protein, 7 aa, Artificial Sequence
  Description of Artificial Sequence: Synthetic peptide
TASSLQS

SEQ ID NO: 915 - protein, 7 aa, Artificial Sequence
  Description of Artificial Sequence: Synthetic peptide
KVSNWDS

SEQ ID NO: 916 - protein, 7 aa, Artificial Sequence
  Description of Artificial Sequence: Synthetic peptide
QDNKRPS

SEQ ID NO: 917 - protein, 7 aa, Artificial Sequence
  Description of Artificial Sequence: Synthetic peptide
DASTLQS

SEQ ID NO: 918 - protein, 7 aa, Artificial Sequence
  Description of Artificial Sequence: Synthetic peptide
DDSDRPS

SEQ ID NO: 919 - protein, 7 aa, Artificial Sequence
  Description of Artificial Sequence: Synthetic peptide
GASSRDT

SEQ ID NO: 920 - protein, 7 aa, Artificial Sequence
  Description of Artificial Sequence: Synthetic peptide
GASARAT

SEQ ID NO: 921 - protein, 7 aa, Artificial Sequence
  Description of Artificial Sequence: Synthetic peptide
GASSLQS

SEQ ID NO: 922 - protein, 7 aa, Artificial Sequence
  Description of Artificial Sequence: Synthetic peptide
AASNLQR

SEQ ID NO: 923 - protein, 7 aa, Artificial Sequence
  Description of Artificial Sequence: Synthetic peptide
QNNKRPS

SEQ ID NO: 924 - protein, 7 aa, Artificial Sequence
  Description of Artificial Sequence: Synthetic peptide
GSSNRAT

SEQ ID NO: 925 - protein, 7 aa, Artificial Sequence
  Description of Artificial Sequence: Synthetic peptide
QDSKRPS

SEQ ID NO: 926 - protein, 7 aa, Artificial Sequence
  Description of Artificial Sequence: Synthetic peptide
GASNRAT

SEQ ID NO: 927 - protein, 7 aa, Artificial Sequence
  Description of Artificial Sequence: Synthetic peptide
GAFSRAS

SEQ ID NO: 928 - protein, 7 aa, Artificial Sequence
  Description of Artificial Sequence: Synthetic peptide
GAFSRAT

SEQ ID NO: 929 - protein, 7 aa, Artificial Sequence
  Description of Artificial Sequence: Synthetic peptide
GASNRAI

SEQ ID NO: 930 - protein, 7 aa, Artificial Sequence
  Description of Artificial Sequence: Synthetic peptide
RDSKRPS

SEQ ID NO: 931 - protein, 7 aa, Artificial Sequence
  Description of Artificial Sequence: Synthetic peptide
SDSNRPS

SEQ ID NO: 932 - protein, 7 aa, Artificial Sequence
  Description of Artificial Sequence: Synthetic peptide
QDNERPS

SEQ ID NO: 933 - protein, 7 aa, Artificial Sequence
  Description of Artificial Sequence: Synthetic peptide
AASSLKS

SEQ ID NO: 934 - protein, 7 aa, Artificial Sequence
  Description of Artificial Sequence: Synthetic peptide
AASNLQS

SEQ ID NO: 935 - protein, 7 aa, Artificial Sequence
  Description of Artificial Sequence: Synthetic peptide
RDRNRPS

SEQ ID NO: 936 - protein, 7 aa, Artificial Sequence
  Description of Artificial Sequence: Synthetic peptide
TTSSLQS

SEQ ID NO: 937 - protein, 7 aa, Artificial Sequence
  Description of Artificial Sequence: Synthetic peptide
GTSIRAS

SEQ ID NO: 938 - protein, 7 aa, Artificial Sequence
  Description of Artificial Sequence: Synthetic peptide
CDSNRPS

SEQ ID NO: 939 - protein, 7 aa, Artificial Sequence
  Description of Artificial Sequence: Synthetic peptide
SASSLQS

SEQ ID NO: 940 - protein, 7 aa, Artificial Sequence
  Description of Artificial Sequence: Synthetic peptide
KGSNWDS

SEQ ID NO: 941 - protein, 7 aa, Artificial Sequence
  Description of Artificial Sequence: Synthetic peptide
GTSTRAT

SEQ ID NO: 942 - protein, 7 aa, Artificial Sequence
  Description of Artificial Sequence: Synthetic peptide
GSSNRAI

SEQ ID NO: 943 - protein, 7 aa, Artificial Sequence
  Description of Artificial Sequence: Synthetic peptide
DNDKRPS

SEQ ID NO: 944 - protein, 7 aa, Artificial Sequence
  Description of Artificial Sequence: Synthetic peptide
ASSSLQS

SEQ ID NO: 945 - protein, 7 aa, Artificial Sequence
  Description of Artificial Sequence: Synthetic peptide
TLSFRAS

SEQ ID NO: 946 - protein, 7 aa, Artificial Sequence
  Description of Artificial Sequence: Synthetic peptide
AASTLLS

SEQ ID NO: 947 - protein, 9 aa, Artificial Sequence
  Description of Artificial Sequence: Synthetic peptide
QQSDSIPRT

SEQ ID NO: 948 - protein, 9 aa, Artificial Sequence
  Description of Artificial Sequence: Synthetic peptide
QQSYSATFT

SEQ ID NO: 949 - protein, 9 aa, Artificial Sequence
  Description of Artificial Sequence: Synthetic peptide
HQSSDLPLT

SEQ ID NO: 950 - protein, 9 aa, Artificial Sequence
  Description of Artificial Sequence: Synthetic peptide
QQSYNTPCS

SEQ ID NO: 951 - protein, 9 aa, Artificial Sequence
  Description of Artificial Sequence: Synthetic peptide
MQRIEFPIT

SEQ ID NO: 952 - protein, 9 aa, Artificial Sequence
  Description of Artificial Sequence: Synthetic peptide
QQYDNLPFT

SEQ ID NO: 953 - protein, 9 aa, Artificial Sequence
  Description of Artificial Sequence: Synthetic peptide
MQHIEFPST

SEQ ID NO: 954 - protein, 9 aa, Artificial Sequence
  Description of Artificial Sequence: Synthetic peptide
HQYDDLPLT

SEQ ID NO: 955 - protein, 9 aa, Artificial Sequence
  Description of Artificial Sequence: Synthetic peptide
QQYDNLPLT

SEQ ID NO: 956 - protein, 10 aa, Artificial Sequence
  Description of Artificial Sequence: Synthetic peptide
QSYDRNNHVV

SEQ ID NO: 957 - protein, 11 aa, Artificial Sequence
  Description of Artificial Sequence: Synthetic peptide
YSTDSSVNHVV

SEQ ID NO: 958 - protein, 9 aa, Artificial Sequence
  Description of Artificial Sequence: Synthetic peptide
QAWDSGTVV

SEQ ID NO: 959 - protein, 9 aa, Artificial Sequence
  Description of Artificial Sequence: Synthetic peptide
LQHSSYPLT

SEQ ID NO: 960 - protein, 10 aa, Artificial Sequence
  Description of Artificial Sequence: Synthetic peptide
QQTNSFPPWT

SEQ ID NO: 961 - protein, 9 aa, Artificial Sequence
  Description of Artificial Sequence: Synthetic peptide
QQSYSTPLT

SEQ ID NO: 962 - protein, 9 aa, Artificial Sequence
  Description of Artificial Sequence: Synthetic peptide
QQYNNWPLT

SEQ ID NO: 963 - protein, 11 aa, Artificial Sequence
  Description of Artificial Sequence: Synthetic peptide
GTWDSSLSAVV

SEQ ID NO: 964 - protein, 9 aa, Artificial Sequence
  Description of Artificial Sequence: Synthetic peptide
QQSSSIPWT

SEQ ID NO: 965 - protein, 9 aa, Artificial Sequence
  Description of Artificial Sequence: Synthetic peptide
MQALQTPFT

SEQ ID NO: 966 - protein, 9 aa, Artificial Sequence
  Description of Artificial Sequence: Synthetic peptide
QQYGSSPRS

SEQ ID NO: 967 - protein, 9 aa, Artificial Sequence
  Description of Artificial Sequence: Synthetic peptide
MQGLQTPPT

SEQ ID NO: 968 - protein, 9 aa, Artificial Sequence
  Description of Artificial Sequence: Synthetic peptide
LQHKSYPFT

SEQ ID NO: 969 - protein, 8 aa, Artificial Sequence
  Description of Artificial Sequence: Synthetic peptide
QQFSNSIT

SEQ ID NO: 970 - protein, 8 aa, Artificial Sequence
  Description of Artificial Sequence: Synthetic peptide
QQYGSSRT

SEQ ID NO: 971 - protein, 9 aa, Artificial Sequence
  Description of Artificial Sequence: Synthetic peptide
QQYNIYPRT

SEQ ID NO: 972 - protein, 9 aa, Artificial Sequence
  Description of Artificial Sequence: Synthetic peptide
MQALQTLIT

SEQ ID NO: 973 - protein, 9 aa, Artificial Sequence
  Description of Artificial Sequence: Synthetic peptide
QAWDSATVI

SEQ ID NO: 974 - protein, 10 aa, Artificial Sequence
  Description of Artificial Sequence: Synthetic peptide
QVWDSSSDVV

SEQ ID NO: 975 - protein, 9 aa, Artificial Sequence
  Description of Artificial Sequence: Synthetic peptide
QQYAILPFT

SEQ ID NO: 976 - protein, 9 aa, Artificial Sequence
  Description of Artificial Sequence: Synthetic peptide
QQSSTIPWT

SEQ ID NO: 977 - protein, 9 aa, Artificial Sequence
  Description of Artificial Sequence: Synthetic peptide
QQYGRSLFT

SEQ ID NO: 978 - protein, 9 aa, Artificial Sequence
  Description of Artificial Sequence: Synthetic peptide
QQYNTYPRT

SEQ ID NO: 979 - protein, 9 aa, Artificial Sequence
  Description of Artificial Sequence: Synthetic peptide
HQYGTSPCS

SEQ ID NO: 980 - protein, 11 aa, Artificial Sequence
  Description of Artificial Sequence: Synthetic peptide
YSTDSSGNHVV

SEQ ID NO: 981 - protein, 9 aa, Artificial Sequence
  Description of Artificial Sequence: Synthetic peptide
QAWDSSTAV

SEQ ID NO: 982 - protein, 10 aa, Artificial Sequence
  Description of Artificial Sequence: Synthetic peptide
QAWDSSTTWV

SEQ ID NO: 983 - protein, 11 aa, Artificial Sequence
  Description of Artificial Sequence: Synthetic peptide
GTWDSSLSVMV

SEQ ID NO: 984 - protein, 9 aa, Artificial Sequence
  Description of Artificial Sequence: Synthetic peptide
MQRIEFPLT

SEQ ID NO: 985 - protein, 10 aa, Artificial Sequence
  Description of Artificial Sequence: Synthetic peptide
QQYGSSPPWT

SEQ ID NO: 986 - protein, 9 aa, Artificial Sequence
  Description of Artificial Sequence: Synthetic peptide
QAWDSSTWV

SEQ ID NO: 987 - protein, 9 aa, Artificial Sequence
  Description of Artificial Sequence: Synthetic peptide
LQHNSYPLT

SEQ ID NO: 988 - protein, 8 aa, Artificial Sequence
  Description of Artificial Sequence: Synthetic peptide
QQFGSSLT

SEQ ID NO: 989 - protein, 8 aa, Artificial Sequence
  Description of Artificial Sequence: Synthetic peptide
QQFGRSFT

SEQ ID NO: 990 - protein, 9 aa, Artificial Sequence
  Description of Artificial Sequence: Synthetic peptide
QQYNNWPWT

SEQ ID NO: 991 - protein, 9 aa, Artificial Sequence
  Description of Artificial Sequence: Synthetic peptide
QQSYSTSLT

SEQ ID NO: 992 - protein, 9 aa, Artificial Sequence
  Description of Artificial Sequence: Synthetic peptide
QVWDSSSVV

SEQ ID NO: 993 - protein, 10 aa, Artificial Sequence
  Description of Artificial Sequence: Synthetic peptide
QVWDSSSDGV

SEQ ID NO: 994 - protein, 9 aa, Artificial Sequence
  Description of Artificial Sequence: Synthetic peptide
QAWDSTTVV

SEQ ID NO: 995 - protein, 10 aa, Artificial Sequence
  Description of Artificial Sequence: Synthetic peptide
QQYGSSSLCS

SEQ ID NO: 996 - protein, 9 aa, Artificial Sequence
  Description of Artificial Sequence: Synthetic peptide
QQANSFPPT

SEQ ID NO: 997 - protein, 9 aa, Artificial Sequence
  Description of Artificial Sequence: Synthetic peptide
LQLNGYPLT

SEQ ID NO: 998 - protein, 9 aa, Artificial Sequence
  Description of Artificial Sequence: Synthetic peptide
QLWDSSTVV

SEQ ID NO: 999 - protein, 9 aa, Artificial Sequence
  Description of Artificial Sequence: Synthetic peptide
QQSYSSPLT

SEQ ID NO: 1000 - protein, 9 aa, Artificial Sequence
  Description of Artificial Sequence: Synthetic peptide
QQTYSAPFT

SEQ ID NO: 1001 - protein, 11 aa, Artificial Sequence
  Description of Artificial Sequence: Synthetic peptide
QVWDSSSDHVV

SEQ ID NO: 1002 - protein, 11 aa, Artificial Sequence
  Description of Artificial Sequence: Synthetic peptide
HACGSSSSDGV

SEQ ID NO: 1003 - protein, 10 aa, Artificial Sequence
  Description of Artificial Sequence: Synthetic peptide
QVWDSSCDGV

SEQ ID NO: 1004 - protein, 10 aa, Artificial Sequence
  Description of Artificial Sequence: Synthetic peptide
IQDTHWPTCS

SEQ ID NO: 1005 - protein, 9 aa, Artificial Sequence
  Description of Artificial Sequence: Synthetic peptide
QVWDSSTVV

SEQ ID NO: 1006 - protein, 9 aa, Artificial Sequence
  Description of Artificial Sequence: Synthetic peptide
QVWDSNPVV

SEQ ID NO: 1007 - protein, 7 aa, Artificial Sequence
  Description of Artificial Sequence: Synthetic peptide
QAWDSRV

SEQ ID NO: 1008 - protein, 8 aa, Artificial Sequence
  Description of Artificial Sequence: Synthetic peptide
QQYGSSCS

SEQ ID NO: 1009 - protein, 9 aa, Artificial Sequence
  Description of Artificial Sequence: Synthetic peptide
QQYNTWPWT

SEQ ID NO: 1010 - protein, 9 aa, Artificial Sequence
  Description of Artificial Sequence: Synthetic peptide
QQYEIWPWT

SEQ ID NO: 1011 - protein, 9 aa, Artificial Sequence
  Description of Artificial Sequence: Synthetic peptide
QQYGSSPWT

SEQ ID NO: 1012 - protein, 9 aa, Artificial Sequence
  Description of Artificial Sequence: Synthetic peptide
MQRLEFPIT

SEQ ID NO: 1013 - protein, 9 aa, Artificial Sequence
  Description of Artificial Sequence: Synthetic peptide
QQSFSTPLT

SEQ ID NO: 1014 - protein, 9 aa, Artificial Sequence
  Description of Artificial Sequence: Synthetic peptide
QVWDSSPVV

SEQ ID NO: 1015 - protein, 9 aa, Artificial Sequence
  Description of Artificial Sequence: Synthetic peptide
LQRNSYPLT

SEQ ID NO: 1016 - protein, 9 aa, Artificial Sequence
  Description of Artificial Sequence: Synthetic peptide
HQYTNWPRT

SEQ ID NO: 1017 - protein, 9 aa, Artificial Sequence
  Description of Artificial Sequence: Synthetic peptide
QQYGTSPFT

SEQ ID NO: 1018 - protein, 9 aa, Artificial Sequence
  Description of Artificial Sequence: Synthetic peptide
LQHNSYPRT

SEQ ID NO: 1019 - protein, 9 aa, Artificial Sequence
  Description of Artificial Sequence: Synthetic peptide
QKYYSAPFT

SEQ ID NO: 1020 - protein, 9 aa, Artificial Sequence
  Description of Artificial Sequence: Synthetic peptide
MEGTHWPRD

SEQ ID NO: 1021 - DNA, 15 bp, Artificial Sequence
  Description of Artificial Sequence: Synthetic oligonucleotide
ggttactactggacc

SEQ ID NO: 1022 - DNA, 15 bp, Artificial Sequence
  Description of Artificial Sequence: Synthetic oligonucleotide
ggttactactggagc

SEQ ID NO: 1023 - DNA, 15 bp, Artificial Sequence
  Description of Artificial Sequence: Synthetic oligonucleotide
agctatagcatgaac

SEQ ID NO: 1024 - DNA, 15 bp, Artificial Sequence
  Description of Artificial Sequence: Synthetic oligonucleotide
ggctactataagcac

SEQ ID NO: 1025 - DNA, 15 bp, Artificial Sequence
  Description of Artificial Sequence: Synthetic oligonucleotide
gaattatccatacac

SEQ ID NO: 1026 - DNA, 15 bp, Artificial Sequence
  Description of Artificial Sequence: Synthetic oligonucleotide
aactatggcatgcac

SEQ ID NO: 1027 - DNA, 15 bp, Artificial Sequence
  Description of Artificial Sequence: Synthetic oligonucleotide
agttatgatatcgac

SEQ ID NO: 1028 - DNA, 15 bp, Artificial Sequence
  Description of Artificial Sequence: Synthetic oligonucleotide
aactatggcatgcgc

SEQ ID NO: 1029 - DNA, 21 bp, Artificial Sequence
  Description of Artificial Sequence: Synthetic oligonucleotide
aatcctagaatgggtgtgagc

SEQ ID NO: 1030 - DNA, 15 bp, Artificial Sequence
  Description of Artificial Sequence: Synthetic oligonucleotide
agttacgatatcaac

SEQ ID NO: 1031 - DNA, 15 bp, Artificial Sequence
  Description of Artificial Sequence: Synthetic oligonucleotide
agctatggcctgcac

SEQ ID NO: 1032 - DNA, 15 bp, Artificial Sequence
  Description of Artificial Sequence: Synthetic oligonucleotide
agctatggcatgcac

SEQ ID NO: 1033 - DNA, 15 bp, Artificial Sequence
  Description of Artificial Sequence: Synthetic oligonucleotide
aactatgccatgagc

SEQ ID NO: 1034 - DNA, 21 bp, Artificial Sequence
  Description of Artificial Sequence: Synthetic oligonucleotide
agtggtggttactactggagc

SEQ ID NO: 1035 - DNA, 15 bp, Artificial Sequence
  Description of Artificial Sequence: Synthetic oligonucleotide
ggctactatttgcac

SEQ ID NO: 1036 - DNA, 15 bp, Artificial Sequence
  Description of Artificial Sequence: Synthetic oligonucleotide
tattattactggagt

SEQ ID NO: 1037 - DNA, 15 bp, Artificial Sequence
  Description of Artificial Sequence: Synthetic oligonucleotide
ggctactatacacac

SEQ ID NO: 1038 - DNA, 15 bp, Artificial Sequence
  Description of Artificial Sequence: Synthetic oligonucleotide
acttactactggagc

SEQ ID NO: 1039 - DNA, 15 bp, Artificial Sequence
  Description of Artificial Sequence: Synthetic oligonucleotide
acctatggcatgcac

SEQ ID NO: 1040 - DNA, 15 bp, Artificial Sequence
  Description of Artificial Sequence: Synthetic oligonucleotide
gattactactggaac

SEQ ID NO: 1041 - DNA, 15 bp, Artificial Sequence
  Description of Artificial Sequence: Synthetic oligonucleotide
agctatgccatgagc

SEQ ID NO: 1042 - DNA, 21 bp, Artificial Sequence
  Description of Artificial Sequence: Synthetic oligonucleotide
agtggtgtttactactggaac

SEQ ID NO: 1043 - DNA, 15 bp, Artificial Sequence
  Description of Artificial Sequence: Synthetic oligonucleotide
agctttggcatgcac

SEQ ID NO: 1044 - DNA, 15 bp, Artificial Sequence
  Description of Artificial Sequence: Synthetic oligonucleotide
agttactactggagc

SEQ ID NO: 1045 - DNA, 15 bp, Artificial Sequence
  Description of Artificial Sequence: Synthetic oligonucleotide
agctactggatcggc

SEQ ID NO: 1046 - DNA, 15 bp, Artificial Sequence
  Description of Artificial Sequence: Synthetic oligonucleotide
agttactactggaac

SEQ ID NO: 1047 - DNA, 21 bp, Artificial Sequence
  Description of Artificial Sequence: Synthetic oligonucleotide
agtagtagttactactggggc

SEQ ID NO: 1048 - DNA, 21 bp, Artificial Sequence
  Description of Artificial Sequence: Synthetic oligonucleotide
agtggtgtttactactggagc

SEQ ID NO: 1049 - DNA, 21 bp, Artificial Sequence
  Description of Artificial Sequence: Synthetic oligonucleotide
agcaacagtgctacttggaac

SEQ ID NO: 1050 - DNA, 15 bp, Artificial Sequence
  Description of Artificial Sequence: Synthetic oligonucleotide
gactcctacatgagc

SEQ ID NO: 1051 - DNA, 15 bp, Artificial Sequence
  Description of Artificial Sequence: Synthetic oligonucleotide
agctatagcatgagt

SEQ ID NO: 1052 - DNA, 15 bp, Artificial Sequence
  Description of Artificial Sequence: Synthetic oligonucleotide
cactatgccatgagc

SEQ ID NO: 1053 - DNA, 15 bp, Artificial Sequence
  Description of Artificial Sequence: Synthetic oligonucleotide
aactatggtatcagc

SEQ ID NO: 1054 - DNA, 15 bp, Artificial Sequence
  Description of Artificial Sequence: Synthetic oligonucleotide
agctatggcatacac

SEQ ID NO: 1055 - DNA, 21 bp, Artificial Sequence
  Description of Artificial Sequence: Synthetic oligonucleotide
agtggtgattactactggacc

SEQ ID NO: 1056 - DNA, 21 bp, Artificial Sequence
  Description of Artificial Sequence: Synthetic oligonucleotide
agtggtgattactactggagc

SEQ ID NO: 1057 - DNA, 21 bp, Artificial Sequence
  Description of Artificial Sequence: Synthetic oligonucleotide
agtggtgattactactggacc

SEQ ID NO: 1058 - DNA, 15 bp, Artificial Sequence
  Description of Artificial Sequence: Synthetic oligonucleotide
aacgcctggatgagt

SEQ ID NO: 1059 - DNA, 21 bp, Artificial Sequence
  Description of Artificial Sequence: Synthetic oligonucleotide
agtggtaattactactggagc

SEQ ID NO: 1060 - DNA, 21 bp, Artificial Sequence
  Description of Artificial Sequence: Synthetic oligonucleotide
agtgatacttcctactggggc

SEQ ID NO: 1061 - DNA, 15 bp, Artificial Sequence
  Description of Artificial Sequence: Synthetic oligonucleotide
agtcatgatatcaac

SEQ ID NO: 1062 - DNA, 21 bp, Artificial Sequence
  Description of Artificial Sequence: Synthetic oligonucleotide
agcaacagtgctgcttggaac

SEQ ID NO: 1063 - DNA, 15 bp, Artificial Sequence
  Description of Artificial Sequence: Synthetic oligonucleotide
ggctactatatacac

SEQ ID NO: 1064 - DNA, 15 bp, Artificial Sequence
  Description of Artificial Sequence: Synthetic oligonucleotide
ggctactttatgcac

SEQ ID NO: 1065 - DNA, 15 bp, Artificial Sequence
  Description of Artificial Sequence: Synthetic oligonucleotide
acctacgacatgcac

SEQ ID NO: 1066 - DNA, 15 bp, Artificial Sequence
  Description of Artificial Sequence: Synthetic oligonucleotide
agttacgacatgcac

SEQ ID NO: 1067 - DNA, 15 bp, Artificial Sequence
  Description of Artificial Sequence: Synthetic oligonucleotide
aactataacatgcac

SEQ ID NO: 1068 - DNA, 15 bp, Artificial Sequence
  Description of Artificial Sequence: Synthetic oligonucleotide
ttctatggcatgcac

SEQ ID NO: 1069 - DNA, 15 bp, Artificial Sequence
  Description of Artificial Sequence: Synthetic oligonucleotide
tactattacattcac

SEQ ID NO: 1070 - DNA, 21 bp, Artificial Sequence
  Description of Artificial Sequence: Synthetic oligonucleotide
agtgatgcttactactggagc

SEQ ID NO: 1071 - DNA, 21 bp, Artificial Sequence
  Description of Artificial Sequence: Synthetic oligonucleotide
agtggtgataactactggagc

SEQ ID NO: 1072 - DNA, 21 bp, Artificial Sequence
  Description of Artificial Sequence: Synthetic oligonucleotide
agtggtggttactactggaac

SEQ ID NO: 1073 - DNA, 15 bp, Artificial Sequence
  Description of Artificial Sequence: Synthetic oligonucleotide
ggctactggatcggc

SEQ ID NO: 1074 - DNA, 48 bp, Artificial Sequence
  Description of Artificial Sequence: Synthetic oligonucleotide
gaaatcaatcatagtgaaaacaccaactacaacccgtccctcaagagt

SEQ ID NO: 1075 - DNA, 48 bp, Artificial Sequence
  Description of Artificial Sequence: Synthetic oligonucleotide
gaaatcactcatactggaagctccaactacaacccgtccctcaagagt

SEQ ID NO: 1076 - DNA, 51 bp, Artificial Sequence
  Description of Artificial Sequence: Synthetic oligonucleotide
tccattagtagtagtagtagttacgaatactacgtagactcagtgaagggc

SEQ ID NO: 1077 - DNA, 51 bp, Artificial Sequence
  Description of Artificial Sequence: Synthetic oligonucleotide
tggatcaaccctaacagtggtgccacaaagtatgcacagaagtttcagggc

SEQ ID NO: 1078 - DNA, 51 bp, Artificial Sequence
  Description of Artificial Sequence: Synthetic oligonucleotide
ggttttgatcctgaagatggtgaaacaatctacgcacagaagttccagggc

SEQ ID NO: 1079 - DNA, 51 bp, Artificial Sequence
  Description of Artificial Sequence: Synthetic oligonucleotide
attatatggtatgatggaagtaataaaaactatgcagactccgtgaagggc

SEQ ID NO: 1080 - DNA, 51 bp, Artificial Sequence
  Description of Artificial Sequence: Synthetic oligonucleotide
tggatgaaccctaacggtggtaacacaggctatgcacagaagttccagggc

SEQ ID NO: 1081 - DNA, 51 bp, Artificial Sequence
  Description of Artificial Sequence: Synthetic oligonucleotide
cttatatggtatgatggaagtaataagttctatgcagactccgtgaagggc

SEQ ID NO: 1082 - DNA, 48 bp, Artificial Sequence
  Description of Artificial Sequence: Synthetic oligonucleotide
cacattttttcgaatgacgaaaaatcctacagcacatctctgaagagc

SEQ ID NO: 1083 - DNA, 51 bp, Artificial Sequence
  Description of Artificial Sequence: Synthetic oligonucleotide
tggatgaacccctacagtgggagcacaggctatgcacagaatttccagggc

SEQ ID NO: 1084 - DNA, 51 bp, Artificial Sequence
  Description of Artificial Sequence: Synthetic oligonucleotide
gttatatggaatgatggaagtaataagctttatgcagactccgtgaagggc

SEQ ID NO: 1085 - DNA, 51 bp, Artificial Sequence
  Description of Artificial Sequence: Synthetic oligonucleotide
gttatatcatatgatggaagtaataaatactatgcagactccgtgaagggc

SEQ ID NO: 1086 - DNA, 51 bp, Artificial Sequence
  Description of Artificial Sequence: Synthetic oligonucleotide
ggtattagtggtagtagtgctggcacatactacgcagactccgtgaagggc

SEQ ID NO: 1087 - DNA, 48 bp, Artificial Sequence
  Description of Artificial Sequence: Synthetic oligonucleotide
tacatctattacaatgggagtccctacgacaacccgtccctcaagagg

SEQ ID NO: 1088 - DNA, 48 bp, Artificial Sequence
  Description of Artificial Sequence: Synthetic oligonucleotide
gaactcgatcatagtggaagtatcaactacaacccgtccctcaagagt

SEQ ID NO: 1089 - DNA, 51 bp, Artificial Sequence
  Description of Artificial Sequence: Synthetic oligonucleotide
tccattagtagtagtagtacttacatatactacgcagactcagtgaagggc

SEQ ID NO: 1090 - DNA, 51 bp, Artificial Sequence
  Description of Artificial Sequence: Synthetic oligonucleotide
tggatcaaccctaacagtgctgccacaaactatgcaccgaagtttcagggc

SEQ ID NO: 1091 - DNA, 48 bp, Artificial Sequence
  Description of Artificial Sequence: Synthetic oligonucleotide
tatatctattatagtgggagcaccaactacaacccctccctcaagagt

SEQ ID NO: 1092 - DNA, 51 bp, Artificial Sequence
  Description of Artificial Sequence: Synthetic oligonucleotide
gttatatggtatgatggaagtaataactattatgcagactccgtgaagggc

SEQ ID NO: 1093 - DNA, 51 bp, Artificial Sequence
  Description of Artificial Sequence: Synthetic oligonucleotide
tggatcaaccctagcagtggtgacacaaagtatgcacagaagtttcagggc

SEQ ID NO: 1094 - DNA, 48 bp, Artificial Sequence
  Description of Artificial Sequence: Synthetic oligonucleotide
tatatcttttacaatgggaacgccaactacagcccctccctgaagagt

SEQ ID NO: 1095 - DNA, 51 bp, Artificial Sequence
  Description of Artificial Sequence: Synthetic oligonucleotide
gttatatggtatgatggaagtaataaatactatgcagactccgtgaagggc

SEQ ID NO: 1096 - DNA, 51 bp, Artificial Sequence
  Description of Artificial Sequence: Synthetic oligonucleotide
cttatatcatatgatggaagtaataaatactatgcagactccgtgaagggc

SEQ ID NO: 1097 - DNA, 48 bp, Artificial Sequence
  Description of Artificial Sequence: Synthetic oligonucleotide
gaaatcaatcatagtggaaccaccaactacaatccgtccctcaagagt

SEQ ID NO: 1098 - DNA, 51 bp, Artificial Sequence
  Description of Artificial Sequence: Synthetic oligonucleotide
tggatgaaccctcacagtggtaacacaggctatgcacagaagttccagggc

SEQ ID NO: 1099 - DNA, 51 bp, Artificial Sequence
  Description of Artificial Sequence: Synthetic oligonucleotide
gctattagtggtagtggtcgtaccacatactccgcagactccgtgaagggc

SEQ ID NO: 1100 - DNA, 48 bp, Artificial Sequence
  Description of Artificial Sequence: Synthetic oligonucleotide
tacctctattacagtgggagcacctactacaacccgtccctcaagagt

SEQ ID NO: 1101 - DNA, 51 bp, Artificial Sequence
  Description of Artificial Sequence: Synthetic oligonucleotide
cttatatggtatgatggagataataaatactatgcagactccgtgaagggc

SEQ ID NO: 1102 - DNA, 48 bp, Artificial Sequence
  Description of Artificial Sequence: Synthetic oligonucleotide
cgtatctatatcagtgggagcaccaactacaacccctccctcgagaat

SEQ ID NO: 1103 - DNA, 51 bp, Artificial Sequence
  Description of Artificial Sequence: Synthetic oligonucleotide
gttatatggtatgatggaagttatcaattctatgcagactccgtgaagggc

SEQ ID NO: 1104 - DNA, 51 bp, Artificial Sequence
  Description of Artificial Sequence: Synthetic oligonucleotide
atcatctatcctggtgactctgataccagatacagcccgtccttccaaggc

SEQ ID NO: 1105 - DNA, 48 bp, Artificial Sequence
  Description of Artificial Sequence: Synthetic oligonucleotide
cgtatctataccagtgggagcaccaactacaatccctccctcaagagt

SEQ ID NO: 1106 - DNA, 48 bp, Artificial Sequence
  Description of Artificial Sequence: Synthetic oligonucleotide
atgatctattatagtgggaccacctactacaacccgtccctcaagagt

SEQ ID NO: 1107 - DNA, 48 bp, Artificial Sequence
  Description of Artificial Sequence: Synthetic oligonucleotide
tacatctattacagtgggagcacctactacaacccgtccctcaagagt

SEQ ID NO: 1108 - DNA, 54 bp, Artificial Sequence
  Description of Artificial Sequence: Synthetic oligonucleotide
aggacatactacaggtccaagtggtataatgattatgcagtatctgtgaaaagt

SEQ ID NO: 1109 - DNA, 51 bp, Artificial Sequence
  Description of Artificial Sequence: Synthetic oligonucleotide
gttatatggaatgatggaaataacaaatactatgcagactccgtgaagggc

SEQ ID NO: 1110 - DNA, 51 bp, Artificial Sequence
  Description of Artificial Sequence: Synthetic oligonucleotide
tccattagtagtagtggtagtatcgtatacttcgcagactctgtgaagggc

SEQ ID NO: 1111 - DNA, 51 bp, Artificial Sequence
  Description of Artificial Sequence: Synthetic oligonucleotide
tccattagtagtagtagtacttacatatactacgcagactcactgaagggc

SEQ ID NO: 1112 - DNA, 51 bp, Artificial Sequence
  Description of Artificial Sequence: Synthetic oligonucleotide
attacatcatatggaggaagtaataaaaattatgcagactccgtgaagggc

SEQ ID NO: 1113 - DNA, 51 bp, Artificial Sequence
  Description of Artificial Sequence: Synthetic oligonucleotide
gctattagtggtagtggtgctggcacattctacgcggactccatgaagggc

SEQ ID NO: 1114 - DNA, 51 bp, Artificial Sequence
  Description of Artificial Sequence: Synthetic oligonucleotide
gttattagtgacagtggtggtagcacatactacgcagactccgtgaagggc

SEQ ID NO: 1115 - DNA, 51 bp, Artificial Sequence
  Description of Artificial Sequence: Synthetic oligonucleotide
tggatcagcgcttacaatggttactcaaactatgcacagaagttccaggac

SEQ ID NO: 1116 - DNA, 51 bp, Artificial Sequence
  Description of Artificial Sequence: Synthetic oligonucleotide
gttattagtggtagtggtggtgacacatactacgcagactccgtgaagggc

SEQ ID NO: 1117 - DNA, 48 bp, Artificial Sequence
  Description of Artificial Sequence: Synthetic oligonucleotide
tacatctattacactgggagcacctactacaacccgtccctcaagagt

SEQ ID NO: 1118 - DNA, 48 bp, Artificial Sequence
  Description of Artificial Sequence: Synthetic oligonucleotide
tacatctattacagtgggaccacctactacaacccgtccctcaagagt

SEQ ID NO: 1119 - DNA, 48 bp, Artificial Sequence
  Description of Artificial Sequence: Synthetic oligonucleotide
tatatctattacactgggagcaccaactacaacccctccctcaagagt

SEQ ID NO: 1120 - DNA, 51 bp, Artificial Sequence
  Description of Artificial Sequence: Synthetic oligonucleotide
tggatgaaccctaatagtggtgccacaaagtatgcacagaagtttcagggc

SEQ ID NO: 1121 - DNA, 51 bp, Artificial Sequence
  Description of Artificial Sequence: Synthetic oligonucleotide
gttatatgggatgatggaagtaataaatactatgcagactccgtgaagggc

SEQ ID NO: 1122 - DNA, 57 bp, Artificial Sequence
  Description of Artificial Sequence: Synthetic oligonucleotide
cgtattaaaagcaaaactgatggtgggacaacagagtacgctgcacccgtgaaaggc

SEQ ID NO: 1123 - DNA, 48 bp, Artificial Sequence
  Description of Artificial Sequence: Synthetic oligonucleotide
tacatctattacagtgggagcgcctactacaacccgtccctcaagagt

SEQ ID NO: 1124 - DNA, 48 bp, Artificial Sequence
  Description of Artificial Sequence: Synthetic oligonucleotide
aatatctattatagtgggaccacctacttcaacccgtccctcaagagt

SEQ ID NO: 1125 - DNA, 48 bp, Artificial Sequence
  Description of Artificial Sequence: Synthetic oligonucleotide
tacattttttacagtgggagcacctactacaacccgtccctcaagagt

SEQ ID NO: 1126 - DNA, 51 bp, Artificial Sequence
  Description of Artificial Sequence: Synthetic oligonucleotide
tggatcaaccctaacagtggtggcacagactatgcacagaagtttcagggc

SEQ ID NO: 1127 - DNA, 51 bp, Artificial Sequence
  Description of Artificial Sequence: Synthetic oligonucleotide
ggtatatcatatgatggaagtaataaaaactatgcagactccgtgaagggc

SEQ ID NO: 1128 - DNA, 51 bp, Artificial Sequence
  Description of Artificial Sequence: Synthetic oligonucleotide
gttatatggtatgatggaagtaataaataccatgcagactccgtgaagggc

SEQ ID NO: 1129 - DNA, 51 bp, Artificial Sequence
  Description of Artificial Sequence: Synthetic oligonucleotide
tggatcaaccctcccagtggtgccacaaactatgcacagaagtttcggggc

SEQ ID NO: 1130 - DNA, 51 bp, Artificial Sequence
  Description of Artificial Sequence: Synthetic oligonucleotide
tggatcaaccctaacagtggtgccacaaactatgcacagaagtttcacggc

SEQ ID NO: 1131 - DNA, 48 bp, Artificial Sequence
  Description of Artificial Sequence: Synthetic oligonucleotide
gctattggtattgctggtgacacatactattcagactccgtgaagggc

SEQ ID NO: 1132 - DNA, 48 bp, Artificial Sequence
  Description of Artificial Sequence: Synthetic oligonucleotide
actattgatactgctggtgacgcttactatccaggctccgtgaagggc

SEQ ID NO: 1133 - DNA, 57 bp, Artificial Sequence
  Description of Artificial Sequence: Synthetic oligonucleotide
cgtattaaaagcaaaactgatggtgggacaacagactacgctgcacccgtgaaaggc

SEQ ID NO: 1134 - DNA, 57 bp, Artificial Sequence
  Description of Artificial Sequence: Synthetic oligonucleotide
cgtattataggcaaaactgatggtgggacaacagactacgctgcacccgtgaaaggc

SEQ ID NO: 1135 - DNA, 51 bp, Artificial Sequence
  Description of Artificial Sequence: Synthetic oligonucleotide
gttatatcatatgatggaagtaacaaacactatgcagactccgtgaagggc

SEQ ID NO: 1136 - DNA, 51 bp, Artificial Sequence
  Description of Artificial Sequence: Synthetic oligonucleotide
gttttatggtatgatggaaatactaaatactatgcagactccgtgaagggc

SEQ ID NO: 1137 - DNA, 51 bp, Artificial Sequence
  Description of Artificial Sequence: Synthetic oligonucleotide
cttatatggtatgatggaagtaataaagactatgcagactccgtgaagggc

SEQ ID NO: 1138 - DNA, 51 bp, Artificial Sequence
  Description of Artificial Sequence: Synthetic oligonucleotide
gttatatggtatgatggaagtaataaagactatgcagactccgtgaagggc

SEQ ID NO: 1139 - DNA, 48 bp, Artificial Sequence
  Description of Artificial Sequence: Synthetic oligonucleotide
tacatctattacagtgggggcacccactacaacccgtccctcaaaagt

SEQ ID NO: 1140 - DNA, 48 bp, Artificial Sequence
  Description of Artificial Sequence: Synthetic oligonucleotide
tatatctattacagtgggaacaccaactacaacccctccctcaagagt

SEQ ID NO: 1141 - DNA, 48 bp, Artificial Sequence
  Description of Artificial Sequence: Synthetic oligonucleotide
tttatctattacagtgggggcaccaactacaacccctccctcaagagt

SEQ ID NO: 1142 - DNA, 48 bp, Artificial Sequence
  Description of Artificial Sequence: Synthetic oligonucleotide
ttcatgttttacagtgggagtaccaactacaacccctccctcaagagt

SEQ ID NO: 1143 - DNA, 51 bp, Artificial Sequence
  Description of Artificial Sequence: Synthetic oligonucleotide
atcatctatcctggtgactctgaaaccagatacagcccgtcctttcaaggc

SEQ ID NO: 1144 - DNA, 48 bp, Artificial Sequence
  Description of Artificial Sequence: Synthetic oligonucleotide
tacatctatgacagtgggagcacctactacaacccgtccctcaagagt

SEQ ID NO: 1145 - DNA, 48 bp, Artificial Sequence
  Description of Artificial Sequence: Synthetic oligonucleotide
agtatctattatagtgggaccacctactacaacccgtccctcaagagt

SEQ ID NO: 1146 - DNA, 51 bp, Artificial Sequence
  Description of Artificial Sequence: Synthetic oligonucleotide
tggatcaaccctgacagtggtggcacaaactatgcacagaagtttcagggc

SEQ ID NO: 1147 - DNA, 51 bp, Artificial Sequence
  Description of Artificial Sequence: Synthetic oligonucleotide
tggatcaaccctaacagtggtggcacaaactatgcacagaagtttcggggc

SEQ ID NO: 1148 - DNA, 51 bp, Artificial Sequence
  Description of Artificial Sequence: Synthetic oligonucleotide
tggatgaacccttacagtggtagcacaggcctcgcacagaggttccaggac

SEQ ID NO: 1149 - DNA, 51 bp, Artificial Sequence
  Description of Artificial Sequence: Synthetic oligonucleotide
tacattagtagtggtagtagtaccatataccacgcagactctgtgaagggc

SEQ ID NO: 1150 - DNA, 48 bp, Artificial Sequence
  Description of Artificial Sequence: Synthetic oligonucleotide
tacatctatcacagtgggagcgcctactacaacccgtccctcaagagt

SEQ ID NO: 1151 - DNA, 27 bp, Artificial Sequence
  Description of Artificial Sequence: Synthetic oligonucleotide
gagagtgggaacttcccctttgactac

SEQ ID NO: 1152 - DNA, 39 bp, Artificial Sequence
  Description of Artificial Sequence: Synthetic oligonucleotide
ggcgggattttatggttcggggagcaggcttttgatatc

SEQ ID NO: 1153 - DNA, 33 bp, Artificial Sequence
  Description of Artificial Sequence: Synthetic oligonucleotide
tccctaagtatagcagtggctgcctctgactac

SEQ ID NO: 1154 - DNA, 48 bp, Artificial Sequence
  Description of Artificial Sequence: Synthetic oligonucleotide
gaggtacccgacggtatagtagtggctggttcaaatgcttttgatttc

SEQ ID NO: 1155 - DNA, 48 bp, Artificial Sequence
  Description of Artificial Sequence: Synthetic oligonucleotide
cattctggttcggggaggttttactactactactacggtatggacgtc

SEQ ID NO: 1156 - DNA, 60 bp, Artificial Sequence
  Description of Artificial Sequence: Synthetic oligonucleotide
gatcaggattacgatttttggagtggttatccttacttctactactacggtatggacgtc

SEQ ID NO: 1157 - DNA, 33 bp, Artificial Sequence
  Description of Artificial Sequence: Synthetic oligonucleotide
gggaaggaatttagcagggcggagtttgactac

SEQ ID NO: 1158 - DNA, 60 bp, Artificial Sequence
  Description of Artificial Sequence: Synthetic oligonucleotide
gatcggtattacgatttttggagtggttatccatacttcttctactacggtctggacgtc

SEQ ID NO: 1159 - DNA, 39 bp, Artificial Sequence
  Description of Artificial Sequence: Synthetic oligonucleotide
gtagataccttgaactaccactactacggtatggacgtc

SEQ ID NO: 1160 - DNA, 30 bp, Artificial Sequence
  Description of Artificial Sequence: Synthetic oligonucleotide
tataattggaactatggggcttttgatttc

SEQ ID NO: 1161 - DNA, 60 bp, Artificial Sequence
  Description of Artificial Sequence: Synthetic oligonucleotide
gatcagtattacgatttttggagcggttacccatactatcactactacggtatggacgtc

SEQ ID NO: 1162 - DNA, 48 bp, Artificial Sequence
  Description of Artificial Sequence: Synthetic oligonucleotide
gcggacggtgactacccatattactactactactacggtatggacgtc

SEQ ID NO: 1163 - DNA, 36 bp, Artificial Sequence
  Description of Artificial Sequence: Synthetic oligonucleotide
gattggagtatagcagtggctggtacttttgactac

SEQ ID NO: 1164 - DNA, 24 bp, Artificial Sequence
  Description of Artificial Sequence: Synthetic oligonucleotide
ggggccctctacggtatggacgtc

SEQ ID NO: 1165 - DNA, 24 bp, Artificial Sequence
  Description of Artificial Sequence: Synthetic oligonucleotide
gtcctgggatctactcttgactat

SEQ ID NO: 1166 - DNA, 39 bp, Artificial Sequence
  Description of Artificial Sequence: Synthetic oligonucleotide
gatacttatatcagtggctggaactacggtatggacgtc

SEQ ID NO: 1167 - DNA, 30 bp, Artificial Sequence
  Description of Artificial Sequence: Synthetic oligonucleotide
gagggtggaacttacaactggttcgacccc

SEQ ID NO: 1168 - DNA, 21 bp, Artificial Sequence
  Description of Artificial Sequence: Synthetic oligonucleotide
ggaactagggcttttgatatc

SEQ ID NO: 1169 - DNA, 33 bp, Artificial Sequence
  Description of Artificial Sequence: Synthetic oligonucleotide
gatcgggcgggagcctctcccggaatggacgtc

SEQ ID NO: 1170 - DNA, 27 bp, Artificial Sequence
  Description of Artificial Sequence: Synthetic oligonucleotide
gtaactggaacggatgcttttgatttc

SEQ ID NO: 1171 - DNA, 39 bp, Artificial Sequence
  Description of Artificial Sequence: Synthetic oligonucleotide
agtggctggtacccgtcctactactacggtatggacgtc

SEQ ID NO: 1172 - DNA, 39 bp, Artificial Sequence
  Description of Artificial Sequence: Synthetic oligonucleotide
gaaacggactacggtgactacgcacgtccttttgaatac

SEQ ID NO: 1173 - DNA, 33 bp, Artificial Sequence
  Description of Artificial Sequence: Synthetic oligonucleotide
ggccactatgatagtagtggtcccagggactac

SEQ ID NO: 1174 - DNA, 39 bp, Artificial Sequence
  Description of Artificial Sequence: Synthetic oligonucleotide
gaggctaactggggctacaactactacggtatggacgtc

SEQ ID NO: 1175 - DNA, 42 bp, Artificial Sequence
  Description of Artificial Sequence: Synthetic oligonucleotide
atattacgatattttgactggttagaatactactttgactac

SEQ ID NO: 1176 - DNA, 30 bp, Artificial Sequence
  Description of Artificial Sequence: Synthetic oligonucleotide
gagggcagctggtcctccttctttgactac

SEQ ID NO: 1177 - DNA, 30 bp, Artificial Sequence
  Description of Artificial Sequence: Synthetic oligonucleotide
gaacagcagtggctggtttattttgactac

SEQ ID NO: 1178 - DNA, 51 bp, Artificial Sequence
  Description of Artificial Sequence: Synthetic oligonucleotide
gatggtattactatggttcggggagttactcactactacggtatggacgtc

SEQ ID NO: 1179 - DNA, 48 bp, Artificial Sequence
  Description of Artificial Sequence: Synthetic oligonucleotide
gaagggtactatgatagtagtggttattactacaacggtatggacgtc

SEQ ID NO: 1180 - DNA, 42 bp, Artificial Sequence
  Description of Artificial Sequence: Synthetic oligonucleotide
aacagtggctgggattacttctactactacggtatggacgtc

SEQ ID NO: 1181 - DNA, 24 bp, Artificial Sequence
  Description of Artificial Sequence: Synthetic oligonucleotide
agtgggagctactcctttgactac

SEQ ID NO: 1182 - DNA, 39 bp, Artificial Sequence
  Description of Artificial Sequence: Synthetic oligonucleotide
gatatctatagcagtggctggagctacggtatggacgtc

SEQ ID NO: 1183 - DNA, 39 bp, Artificial Sequence
  Description of Artificial Sequence: Synthetic oligonucleotide
gatcacgtttggaggacttatcgttatatctttgactac

SEQ ID NO: 1184 - DNA, 24 bp, Artificial Sequence
  Description of Artificial Sequence: Synthetic oligonucleotide
gcacaactggggatctttgactac

SEQ ID NO: 1185 - DNA, 45 bp, Artificial Sequence
  Description of Artificial Sequence: Synthetic oligonucleotide
ggcggatacagctatggttacgaggactactacggtatggacgtc

SEQ ID NO: 1186 - DNA, 21 bp, Artificial Sequence
  Description of Artificial Sequence: Synthetic oligonucleotide
ggccctctttggtttgactac

SEQ ID NO: 1187 - DNA, 30 bp, Artificial Sequence
  Description of Artificial Sequence: Synthetic oligonucleotide
gtggcagcagtttactggtatttcgatctc

SEQ ID NO: 1188 - DNA, 24 bp, Artificial Sequence
  Description of Artificial Sequence: Synthetic oligonucleotide
gggataactggaactattgacttc

SEQ ID NO: 1189 - DNA, 33 bp, Artificial Sequence
  Description of Artificial Sequence: Synthetic oligonucleotide
attgtagtagtaccagctgttctctttgactac

SEQ ID NO: 1190 - DNA, 60 bp, Artificial Sequence
  Description of Artificial Sequence: Synthetic oligonucleotide
gatcagaattacgatttttggaatggttatccctactacttctactacggtatggacgtc

SEQ ID NO: 1191 - DNA, 39 bp, Artificial Sequence
  Description of Artificial Sequence: Synthetic oligonucleotide
gagacgtttagcagtggctggttcgatgcttttgatatc

SEQ ID NO: 1192 - DNA, 39 bp, Artificial Sequence
  Description of Artificial Sequence: Synthetic oligonucleotide
gatcgatggagcagtggctggaacgaaggttttgactat

SEQ ID NO: 1193 - DNA, 21 bp, Artificial Sequence
  Description of Artificial Sequence: Synthetic oligonucleotide
actacgggtgcttctgatatc

SEQ ID NO: 1194 - DNA, 24 bp, Artificial Sequence
  Description of Artificial Sequence: Synthetic oligonucleotide
gaggccgggtatagctttgactac

SEQ ID NO: 1195 - DNA, 36 bp, Artificial Sequence
  Description of Artificial Sequence: Synthetic oligonucleotide
gatcttagaatagcagtggctggttcatttgactac

SEQ ID NO: 1196 - DNA, 36 bp, Artificial Sequence; identical to SEQ ID NO: 1195
  Description of Artificial Sequence: Synthetic oligonucleotide

SEQ ID NO: 1197 - DNA, 60 bp, Artificial Sequence
  Description of Artificial Sequence: Synthetic oligonucleotide
gatcagtatttcgatttttggagtggttatcctttcttctactactacggtatggacgtc

SEQ ID NO: 1198 - DNA, 39 bp, Artificial Sequence
  Description of Artificial Sequence: Synthetic oligonucleotide
gatcatagcagtggctggtactactacggtatggacgtc

SEQ ID NO: 1199 - DNA, 39 bp, Artificial Sequence
  Description of Artificial Sequence: Synthetic oligonucleotide
gatcataccagtggctggtactactacggtatggacgtc

SEQ ID NO: 1200 - DNA, 42 bp, Artificial Sequence
  Description of Artificial Sequence: Synthetic oligonucleotide
acggtgactaaggaggactactactactacggtatggacgtc

SEQ ID NO: 1201 - DNA, 30 bp, Artificial Sequence
  Description of Artificial Sequence: Synthetic oligonucleotide
atgactaccccttactggtacttcgatctc

SEQ ID NO: 1202 - DNA, 30 bp, Artificial Sequence
  Description of Artificial Sequence: Synthetic oligonucleotide
atgactactccttactggtacttcggtctc

SEQ ID NO: 1203 - DNA, 33 bp, Artificial Sequence
  Description of Artificial Sequence: Synthetic oligonucleotide
gaatattactatggttcggggagttattatcct

SEQ ID NO: 1204 - DNA, 30 bp, Artificial Sequence
  Description of Artificial Sequence: Synthetic oligonucleotide
gaactcggtgactaccccttttttgactac

SEQ ID NO: 1205 - DNA, 30 bp, Artificial Sequence
  Description of Artificial Sequence: Synthetic oligonucleotide
gaatacgtagcagaagctggttttgactac

SEQ ID NO: 1206 - DNA, 42 bp, Artificial Sequence
  Description of Artificial Sequence: Synthetic oligonucleotide
gatagtagtgggagctactacgtggaggactactttgactac

SEQ ID NO: 1207 - DNA, 30 bp, Artificial Sequence
  Description of Artificial Sequence: Synthetic oligonucleotide
ctccgaggggtctactggtacttcgatctc

SEQ ID NO: 1208 - DNA, 30 bp, Artificial Sequence
  Description of Artificial Sequence: Synthetic oligonucleotide
atgacttccccttactggtacttcgatctc

SEQ ID NO: 1209 - DNA, 33 bp, Artificial Sequence
  Description of Artificial Sequence: Synthetic oligonucleotide
gacgcagcaactggtcgctactactttgacaac

SEQ ID NO: 1210 - DNA, 33 bp, Artificial Sequence
  Description of Artificial Sequence: Synthetic oligonucleotide
gatcctggatacagctatggtcactttgactac

SEQ ID NO: 1211 - DNA, 30 bp, Artificial Sequence
  Description of Artificial Sequence: Synthetic oligonucleotide
gagactggaacttggagcttctttgactac

SEQ ID NO: 1212 - DNA, 30 bp, Artificial Sequence
  Description of Artificial Sequence: Synthetic oligonucleotide
gaactggggatcttcaactggttcgacccc

SEQ ID NO: 1213 - DNA, 45 bp, Artificial Sequence
  Description of Artificial Sequence: Synthetic oligonucleotide
gatcggagcagtggccggttcggggactactacggtatggacgtc

SEQ ID NO: 1214 - DNA, 45 bp, Artificial Sequence
  Description of Artificial Sequence: Synthetic oligonucleotide
gatcggagcagtggccggttcggggacttctacggtatggacgtc

SEQ ID NO: 1215 - DNA, 48 bp, Artificial Sequence
  Description of Artificial Sequence: Synthetic oligonucleotide
gaattactatggttcggggagtatggggtagaccacggtatggacgtc

SEQ ID NO: 1216 - DNA, 27 bp, Artificial Sequence
  Description of Artificial Sequence: Synthetic oligonucleotide
gatgtctacggtgactattttgcgtac

SEQ ID NO: 1217 - DNA, 27 bp, Artificial Sequence
  Description of Artificial Sequence: Synthetic oligonucleotide
gccctcaactggaacttttttgactac

SEQ ID NO: 1218 - DNA, 30 bp, Artificial Sequence
  Description of Artificial Sequence: Synthetic oligonucleotide
gaagggacaactcgacggggatttgactac

SEQ ID NO: 1219 - DNA, 33 bp, Artificial Sequence
  Description of Artificial Sequence: Synthetic oligonucleotide
tcagcagtggctttgtacaactggttcgacccc

SEQ ID NO: 1220 - DNA, 39 bp, Artificial Sequence
  Description of Artificial Sequence: Synthetic oligonucleotide
gagtctaggatattgtacttcaacgggtacttccagcac

SEQ ID NO: 1221 - DNA, 48 bp, Artificial Sequence
  Description of Artificial Sequence: Synthetic oligonucleotide
gtcctccattactctgatagtcgtggttactcgtactactctgacttc

SEQ ID NO: 1222 - DNA, 48 bp, Artificial Sequence
  Description of Artificial Sequence: Synthetic oligonucleotide
gtcctccattactatgatagtagtggttactcgtactactttgactac

SEQ ID NO: 1223 - DNA, 39 bp, Artificial Sequence
  Description of Artificial Sequence: Synthetic oligonucleotide
tatagcagcacctgggactactattacggtgtggacgtc

SEQ ID NO: 1224 - DNA, 39 bp, Artificial Sequence
  Description of Artificial Sequence: Synthetic oligonucleotide
tataggagtgactgggactactactacggtatggacgtc

SEQ ID NO: 1225 - DNA, 42 bp, Artificial Sequence
  Description of Artificial Sequence: Synthetic oligonucleotide
cgggcctcacgtggatacagatttggtcttgcttttgcgatc

SEQ ID NO: 1226 - DNA, 42 bp, Artificial Sequence
  Description of Artificial Sequence: Synthetic oligonucleotide
cgggcctcacgtggatacagatatggtcttgcttttgctatc

SEQ ID NO: 1227 - DNA, 33 bp, Artificial Sequence
  Description of Artificial Sequence: Synthetic oligonucleotide
gtagcagtgtctgccttcaactggttcgacccc

SEQ ID NO: 1228 - DNA, 54 bp, Artificial Sequence
  Description of Artificial Sequence: Synthetic oligonucleotide
gatgttctaatggtgtatactaaagggggctactactattacggtgtggacgtc

SEQ ID NO: 1229 - DNA, 42 bp, Artificial Sequence
  Description of Artificial Sequence: Synthetic oligonucleotide
cgggcctcacgtggatacagctatggtcatgcttttgatttc

SEQ ID NO: 1230 - DNA, 39 bp, Artificial Sequence
  Description of Artificial Sequence: Synthetic oligonucleotide
gaccttagcagtggctactactactacggtttggacgtg

SEQ ID NO: 1231 - DNA, 36 bp, Artificial Sequence
  Description of Artificial Sequence: Synthetic oligonucleotide
gaggaagactacagtgaccaccactactttgactac

SEQ ID NO: 1232 - DNA, 33 bp, Artificial Sequence
  Description of Artificial Sequence: Synthetic oligonucleotide
cgggcaagtcagaacattaggacctatttaaat

SEQ ID NO: 1233 - DNA, 33 bp, Artificial Sequence
  Description of Artificial Sequence: Synthetic oligonucleotide
cgggcaagtcagaggattagcagttatttaaat

SEQ ID NO: 1234 - DNA, 33 bp, Artificial Sequence
  Description of Artificial Sequence: Synthetic oligonucleotide
cgggccagtcaggacattggtaatagcttacac

SEQ ID NO: 1235 - DNA, 33 bp, Artificial Sequence
  Description of Artificial Sequence: Synthetic oligonucleotide
cgggcaagtcagaacattaggagctatttaaat

SEQ ID NO: 1236 - DNA, 51 bp, Artificial Sequence
  Description of Artificial Sequence: Synthetic oligonucleotide
aggtctagtcagagcctcttggatagtgatgatggaaacacctatttggac

SEQ ID NO: 1237 - DNA, 33 bp, Artificial Sequence
  Description of Artificial Sequence: Synthetic oligonucleotide
caggcgagtcaggacattaacatctatttaaat

SEQ ID NO: 1238 - DNA, 51 bp, Artificial Sequence
  Description of Artificial Sequence: Synthetic oligonucleotide
aggtctagtcagagcctcttggatagtgatgatggagacacctatttggac

SEQ ID NO: 1239 - DNA, 33 bp, Artificial Sequence
  Description of Artificial Sequence: Synthetic oligonucleotide
caggcgagtcagggcattagcaactatttaaat

SEQ ID NO: 1240 - DNA, 33 bp, Artificial Sequence
  Description of Artificial Sequence: Synthetic oligonucleotide
caggcgagtcaagacattaccaaatatttaaat

SEQ ID NO: 1241 - DNA, 39 bp, Artificial Sequence
  Description of Artificial Sequence: Synthetic oligonucleotide
acccgcagcagtggcagcattgccagcgactatgtgcag

SEQ ID NO: 1242 - DNA, 33 bp, Artificial Sequence
  Description of Artificial Sequence: Synthetic oligonucleotide
tctggagatgcattgccaaaaaaatatgcttat

SEQ ID NO: 1243 - DNA, 33 bp, Artificial Sequence
  Description of Artificial Sequence: Synthetic oligonucleotide
tctggagataaattgggggataaatacgtttgc

SEQ ID NO: 1244 - DNA, 33 bp, Artificial Sequence
  Description of Artificial Sequence: Synthetic oligonucleotide
cgggcaagtcaggacattagaaatgatttaggc

SEQ ID NO: 1245 - DNA, 33 bp, Artificial Sequence
  Description of Artificial Sequence: Synthetic oligonucleotide
cgggcgagtcagggtattagcagctggttagcc

SEQ ID NO: 1246 - DNA, 33 bp, Artificial Sequence
  Description of Artificial Sequence: Synthetic oligonucleotide
cgggcaagtcagactattagcagttatttaaat

SEQ ID NO: 1247 - DNA, 33 bp, Artificial Sequence
  Description of Artificial Sequence: Synthetic oligonucleotide
agggccagtcagagtgttagcgacatcttagcc

SEQ ID NO: 1248 - DNA, 39 bp, Artificial Sequence
  Description of Artificial Sequence: Synthetic oligonucleotide
tctggaagcagctccaacattgggattaattatgtatcc

SEQ ID NO: 1249 - DNA, 33 bp, Artificial Sequence
  Description of Artificial Sequence: Synthetic oligonucleotide
cgggcaagtcagagcattagcaactatttaaat

SEQ ID NO: 1250 - DNA, 48 bp, Artificial Sequence
  Description of Artificial Sequence: Synthetic oligonucleotide
aggtctagtcagagcctcctgcatagtaatggatacaactatttggat

SEQ ID NO: 1251 - DNA, 36 bp, Artificial Sequence
  Description of Artificial Sequence: Synthetic oligonucleotide
agggccagtcagagtgttagaagcagctacttagcc

SEQ ID NO: 1252 - DNA, 48 bp, Artificial Sequence
  Description of Artificial Sequence: Synthetic oligonucleotide
aggtctagtcagagcctccagcatagtaatggatacaactatttggat

SEQ ID NO: 1253 - DNA, 33 bp, Artificial Sequence
  Description of Artificial Sequence: Synthetic oligonucleotide
cgggcaagtcagggcattagaaatgatttaggc

SEQ ID NO: 1254 - DNA, 33 bp, Artificial Sequence
  Description of Artificial Sequence: Synthetic oligonucleotide
agggccagtcagagtgttagcagcaacgtcgcc

SEQ ID NO: 1255 - DNA, 33 bp, Artificial Sequence
  Description of Artificial Sequence: Synthetic oligonucleotide
caggcgagtcaggacattagcatctatttaaat

SEQ ID NO: 1256 - DNA, 36 bp, Artificial Sequence
  Description of Artificial Sequence: Synthetic oligonucleotide
agggccagtcagagttttagcagcagttacttagcc

SEQ ID NO: 1257 - DNA, 33 bp, Artificial Sequence
  Description of Artificial Sequence: Synthetic oligonucleotide
cgggcgagtcaggacattagcaattatttagcc

SEQ ID NO: 1258 - DNA, 48 bp, Artificial Sequence
  Description of Artificial Sequence: Synthetic oligonucleotide
aggtctagtcagagcctcctgcatagtaacggattcaactatttggat

SEQ ID NO: 1259 - DNA, 33 bp, Artificial Sequence
  Description of Artificial Sequence: Synthetic oligonucleotide
tctggagacgaattgggggataaatatgcttgc

SEQ ID NO: 1260 - DNA, 33 bp, Artificial Sequence
  Description of Artificial Sequence: Synthetic oligonucleotide
cgggcgagtcaggatattagcagttggttagcc

SEQ ID NO: 1261 - DNA, 33 bp, Artificial Sequence
  Description of Artificial Sequence: Synthetic oligonucleotide
gggggaaacgacattggaagtaaaagtgtgcac

SEQ ID NO: 1262 - DNA, 33 bp, Artificial Sequence
  Description of Artificial Sequence: Synthetic oligonucleotide
caggcgagtcaggacattaaaaaatttttaaat

SEQ ID NO: 1263 - DNA, 34 bp, Artificial Sequence
  Description of Artificial Sequence: Synthetic oligonucleotide
cagggccaggcagagtgttggcagtaacttaatc

SEQ ID NO: 1264 - DNA, 36 bp, Artificial Sequence
  Description of Artificial Sequence: Synthetic oligonucleotide
agggccagtcagagtgttagcagagactacttagcc

SEQ ID NO: 1265 - DNA, 33 bp, Artificial Sequence
  Description of Artificial Sequence: Synthetic oligonucleotide
cgggcgagtcatgacattagcaattatttagcc

SEQ ID NO: 1266 - DNA, 36 bp, Artificial Sequence
  Description of Artificial Sequence: Synthetic oligonucleotide
agggccagtccgagtgttagcagcagctacttagcc

SEQ ID NO: 1267 - DNA, 33 bp, Artificial Sequence
  Description of Artificial Sequence: Synthetic oligonucleotide
agggccagtcagagtattagcagcaatttagcc

SEQ ID NO: 1268 - DNA, 33 bp, Artificial Sequence
  Description of Artificial Sequence: Synthetic oligonucleotide
cgggcgagtcaggatattgacagctggttagtc

SEQ ID NO: 1269 - DNA, 33 bp, Artificial Sequence
  Description of Artificial Sequence: Synthetic oligonucleotide
tctggagatgcagtgccaaaaaaatatgctaat

SEQ ID NO: 1270 - DNA, 33 bp, Artificial Sequence
  Description of Artificial Sequence: Synthetic oligonucleotide
tctggagataatttgggggataaatatgcttgc

SEQ ID NO: 1271 - DNA, 33 bp, Artificial Sequence
  Description of Artificial Sequence: Synthetic oligonucleotide
tctggagataatttgggggataaatatgctttc

SEQ ID NO: 1272 - DNA, 39 bp, Artificial Sequence
  Description of Artificial Sequence: Synthetic oligonucleotide
tctggaagcagctccaacattggggataattatgtatcc

SEQ ID NO: 1273 - DNA, 33 bp, Artificial Sequence
  Description of Artificial Sequence: Synthetic oligonucleotide
cgggcaagtcagaccattagcatctatttaaat

SEQ ID NO: 1274 - DNA, 36 bp, Artificial Sequence
  Description of Artificial Sequence: Synthetic oligonucleotide
agggccagtcagagggttcccagcagctacatagtc

SEQ ID NO: 1275 - DNA, 33 bp, Artificial Sequence
  Description of Artificial Sequence: Synthetic oligonucleotide
tctggaaataaattgggggataaatatgtttgc

SEQ ID NO: 1276 - DNA, 36 bp, Artificial Sequence
  Description of Artificial Sequence: Synthetic oligonucleotide
agggccagtcagagagttcccagcagctacttagtc

SEQ ID NO: 1277 - DNA, 36 bp, Artificial Sequence
  Description of Artificial Sequence: Synthetic oligonucleotide
agggccagtcagagtgttaggaacagctacttagcc

SEQ ID NO: 1278 - DNA, 36 bp, Artificial Sequence
  Description of Artificial Sequence: Synthetic oligonucleotide
agggccagtcagagtgttagtaacagctacttagcc

SEQ ID NO: 1279 - DNA, 33 bp, Artificial Sequence
  Description of Artificial Sequence: Synthetic oligonucleotide
agggccagtcagagtgttagcagccagttagcc

SEQ ID NO: 1280 - DNA, 33 bp, Artificial Sequence
  Description of Artificial Sequence: Synthetic oligonucleotide
cggacaagtcagagtattagcagctatttaaat

SEQ ID NO: 1281 - DNA, 33 bp, Artificial Sequence
  Description of Artificial Sequence: Synthetic oligonucleotide
cggacaagtcagagcattagcaactatttaaat

SEQ ID NO: 1282 - DNA, 33 bp, Artificial Sequence
  Description of Artificial Sequence: Synthetic oligonucleotide
gggggaaacaacattggaagtaaaaatgtacac

SEQ ID NO: 1283 - DNA, 33 bp, Artificial Sequence
  Description of Artificial Sequence: Synthetic oligonucleotide
gggggaaacaacattggaagtaaagctgtgcac

SEQ ID NO: 1284 - DNA, 33 bp, Artificial Sequence
  Description of Artificial Sequence: Synthetic oligonucleotide
tctggagataaattgggggataaatatgcttgc

SEQ ID NO: 1285 - DNA, 36 bp, Artificial Sequence
  Description of Artificial Sequence: Synthetic oligonucleotide
agggccagtcagactgttaggaacaactacttagcc

SEQ ID NO: 1286 - DNA, 36 bp, Artificial Sequence
  Description of Artificial Sequence: Synthetic oligonucleotide
agggccagtcagagtgttagtcgcaactacttagcc

SEQ ID NO: 1287 - DNA, 36 bp, Artificial Sequence
  Description of Artificial Sequence: Synthetic oligonucleotide
agggccagtcagactattaggaacagctacttagcc

SEQ ID NO: 1288 - DNA, 33 bp, Artificial Sequence
  Description of Artificial Sequence: Synthetic oligonucleotide
cgggcgagtcagggtattagcaggtggttagcc

SEQ ID NO: 1289 - DNA, 33 bp, Artificial Sequence
  Description of Artificial Sequence: Synthetic oligonucleotide
cgggcaagtcagagcattagcagctatttaaat

SEQ ID NO: 1290 - DNA, 33 bp, Artificial Sequence
  Description of Artificial Sequence: Synthetic oligonucleotide
gggggtaacaacattggaagtataaatgtgcac

SEQ ID NO: 1291 - DNA, 33 bp, Artificial Sequence
  Description of Artificial Sequence: Synthetic oligonucleotide
cgggcaagtcagatcattagcaggtatttaaat

SEQ ID NO: 1292 - DNA, 33 bp, Artificial Sequence
  Description of Artificial Sequence: Synthetic oligonucleotide
cgggcaagtcagaacattaacaactatttaaat

SEQ ID NO: 1293 - DNA, 33 bp, Artificial Sequence
  Description of Artificial Sequence: Synthetic oligonucleotide
gggggaaacaacattggaagtaaaagtgtgcac

SEQ ID NO: 1294 - DNA, 33 bp, Artificial Sequence
  Description of Artificial Sequence: Synthetic oligonucleotide
gggggaaacaacattggaagtaaaagtgtgcag

SEQ ID NO: 1295 - DNA, 36 bp, Artificial Sequence
  Description of Artificial Sequence: Synthetic oligonucleotide
agggccagtcagagtgttagtcgcagccacttagcc

SEQ ID NO: 1296 - DNA, 33 bp, Artificial Sequence
  Description of Artificial Sequence: Synthetic oligonucleotide
gggggaaacaacattggaagtaaaactgtgcac

SEQ ID NO: 1297 - DNA, 48 bp, Artificial Sequence
  Description of Artificial Sequence: Synthetic oligonucleotide
aggtctagtccaagcctcgtatacagtgatggaaacacctacttgaat

SEQ ID NO: 1298 - DNA, 33 bp, Artificial Sequence
  Description of Artificial Sequence: Synthetic oligonucleotide
gggggaaatgacattggaagtaaaaatgtgcac

SEQ ID NO: 1299 - DNA, 33 bp, Artificial Sequence
  Description of Artificial Sequence: Synthetic oligonucleotide
cgggcaagtcagagcattggcacctttttaaat

SEQ ID NO: 1300 - DNA, 33 bp, Artificial Sequence
  Description of Artificial Sequence: Synthetic oligonucleotide
gggggaaacaacattggaagttacaatgtgttc

SEQ ID NO: 1301 - DNA, 36 bp, Artificial Sequence
  Description of Artificial Sequence: Synthetic oligonucleotide
agggccagtcagagtgttagcagcatgtacttagcc

SEQ ID NO: 1302 - DNA, 33 bp, Artificial Sequence
  Description of Artificial Sequence: Synthetic oligonucleotide
agggccagtcagagtgttaacagcaacttagcc

SEQ ID NO: 1303 - DNA, 33 bp, Artificial Sequence
  Description of Artificial Sequence: Synthetic oligonucleotide
agggccagtcagagtgttagcagcaacttagcc

SEQ ID NO: 1304 - DNA, 39 bp, Artificial Sequence
  Description of Artificial Sequence: Synthetic oligonucleotide
tctggaagcagctccaatattgggaataattatgtagcc

SEQ ID NO: 1305 - DNA, 39 bp, Artificial Sequence
  Description of Artificial Sequence: Synthetic oligonucleotide
tctggaagcagttccaacattggaaataattatgtatcc

SEQ ID NO: 1306 - DNA, 51 bp, Artificial Sequence
  Description of Artificial Sequence: Synthetic oligonucleotide
aggtctagtcagagcctcttaaatagtgatgatggaaatacctatttggac

SEQ ID NO: 1307 - DNA, 33 bp, Artificial Sequence
  Description of Artificial Sequence: Synthetic oligonucleotide
cgggcaagtcaggacattagaaatgatttagcc

SEQ ID NO: 1308 - DNA, 51 bp, Artificial Sequence
  Description of Artificial Sequence: Synthetic oligonucleotide
aggtctagtcagagcctcttaaatagtgatgctggtaccacctatttggac

SEQ ID NO: 1309 - DNA, 48 bp, Artificial Sequence
  Description of Artificial Sequence: Synthetic oligonucleotide
aggtctagtcaaagactcgtatacagtgatggaaacacctacttgaat

SEQ ID NO: 1310 - DNA, 36 bp, Artificial Sequence
  Description of Artificial Sequence: Synthetic oligonucleotide
agggccagtcagagtgttgccagcagttacttagtc

SEQ ID NO: 1311 - DNA, 51 bp, Artificial Sequence
  Description of Artificial Sequence: Synthetic oligonucleotide
aggtctagtcagagcctcttcgataatgatgatggagacacctatttggac

SEQ ID NO: 1312 - DNA, 21 bp, Artificial Sequence
  Description of Artificial Sequence: Synthetic oligonucleotide
gttgcatccagtttggaaagt

SEQ ID NO: 1313 - DNA, 21 bp, Artificial Sequence
  Description of Artificial Sequence: Synthetic oligonucleotide
gctgtatccagtttgcaaagt

SEQ ID NO: 1314 - DNA, 21 bp, Artificial Sequence
  Description of Artificial Sequence: Synthetic oligonucleotide
tttgcttcccagtccttctca

SEQ ID NO: 1315 - DNA, 21 bp, Artificial Sequence
  Description of Artificial Sequence: Synthetic oligonucleotide
ggtgcatctaatttacagagt

SEQ ID NO: 1316 - DNA, 21 bp, Artificial Sequence
  Description of Artificial Sequence: Synthetic oligonucleotide
acgctttcctatcgggcctct

SEQ ID NO: 1317 - DNA, 21 bp, Artificial Sequence
  Description of Artificial Sequence: Synthetic oligonucleotide
gatgtatccaatttggaaaca

SEQ ID NO: 1318 - DNA, 21 bp, Artificial Sequence
  Description of Artificial Sequence: Synthetic oligonucleotide
gatgcatccaatttggaaaca

SEQ ID NO: 1319 - DNA, 21 bp, Artificial Sequence
  Description of Artificial Sequence: Synthetic oligonucleotide
gatacattcattttggaaaca

SEQ ID NO: 1320 - DNA, 21 bp, Artificial Sequence
  Description of Artificial Sequence: Synthetic oligonucleotide
gaggataaagaaagatcctct

SEQ ID NO: 1321 - DNA, 21 bp, Artificial Sequence
  Description of Artificial Sequence: Synthetic oligonucleotide
gaggacagcaaacgaccctcc

SEQ ID NO: 1322 - DNA, 21 bp, Artificial Sequence
  Description of Artificial Sequence: Synthetic oligonucleotide
caaaataacaagcggccctca

SEQ ID NO: 1323 - DNA, 21 bp, Artificial Sequence
  Description of Artificial Sequence: Synthetic oligonucleotide
gctgcatccagtttgcaattt

SEQ ID NO: 1324 - DNA, 21 bp, Artificial Sequence
  Description of Artificial Sequence: Synthetic oligonucleotide
gatgcatccagtttgcaaagt

SEQ ID NO: 1325 - DNA, 21 bp, Artificial Sequence
  Description of Artificial Sequence: Synthetic oligonucleotide
gctgcatccagtttgcaaagt

SEQ ID NO: 1326 - DNA, 21 bp, Artificial Sequence
  Description of Artificial Sequence: Synthetic oligonucleotide
ggtgcatccaccagggccact

SEQ ID NO: 1327 - DNA, 21 bp, Artificial Sequence
  Description of Artificial Sequence: Synthetic oligonucleotide
gacaataataagcgaccctca

SEQ ID NO: 1328 - DNA, 21 bp, Artificial Sequence
  Description of Artificial Sequence: Synthetic oligonucleotide
ttgggttctaatcgggcctcc

SEQ ID NO: 1329 - DNA, 21 bp, Artificial Sequence
  Description of Artificial Sequence: Synthetic oligonucleotide
ggtgcatccaggagggccact

SEQ ID NO: 1330 - DNA, 21 bp, Artificial Sequence
  Description of Artificial Sequence: Synthetic oligonucleotide
ttggattctaatcgggcctcc

SEQ ID NO: 1331 - DNA, 21 bp, Artificial Sequence
  Description of Artificial Sequence: Synthetic oligonucleotide
ggtgcatccagcagggccact

SEQ ID NO: 1332 - DNA, 21 bp, Artificial Sequence
  Description of Artificial Sequence: Synthetic oligonucleotide
acagcttccagtttgcaaagt

SEQ ID NO: 1333 - DNA, 21 bp, Artificial Sequence
  Description of Artificial Sequence: Synthetic oligonucleotide
aaggtttctaactgggactct

SEQ ID NO: 1334 - DNA, 21 bp, Artificial Sequence
  Description of Artificial Sequence: Synthetic oligonucleotide
caagataccaagcggccctca

SEQ ID NO: 1335 - DNA, 21 bp, Artificial Sequence
  Description of Artificial Sequence: Synthetic oligonucleotide
gatgcatccactttgcaaagt

SEQ ID NO: 1336 - DNA, 21 bp, Artificial Sequence
  Description of Artificial Sequence: Synthetic oligonucleotide
gatgatagcgaccggccctca

SEQ ID NO: 1337 - DNA, 21 bp, Artificial Sequence
  Description of Artificial Sequence: Synthetic oligonucleotide
ggtgcatccagcagggacact

SEQ ID NO: 1338 - DNA, 21 bp, Artificial Sequence
  Description of Artificial Sequence: Synthetic oligonucleotide
ggtgcatccgccagggccact

SEQ ID NO: 1339 - DNA, 21 bp, Artificial Sequence
  Description of Artificial Sequence: Synthetic oligonucleotide
ggtgcatccagtttgcaaagt

SEQ ID NO: 1340 - DNA, 21 bp, Artificial Sequence
  Description of Artificial Sequence: Synthetic oligonucleotide
gctgcatccaatttgcaaaga

SEQ ID NO: 1341 - DNA, 21 bp, Artificial Sequence
  Description of Artificial Sequence: Synthetic oligonucleotide
caagataccaagcggccctca

SEQ ID NO: 1342 - DNA, 21 bp, Artificial Sequence
  Description of Artificial Sequence: Synthetic oligonucleotide
ggttcatccaacagggccact

SEQ ID NO: 1343 - DNA, 21 bp, Artificial Sequence
  Description of Artificial Sequence: Synthetic oligonucleotide
caagatagcaagcggccctca

SEQ ID NO: 1344 - DNA, 21 bp, Artificial Sequence
  Description of Artificial Sequence: Synthetic oligonucleotide
ggtgcatccaacagggccaca

SEQ ID NO: 1345 - DNA, 21 bp, Artificial Sequence
  Description of Artificial Sequence: Synthetic oligonucleotide
ggtgcatttagcagggcctct

SEQ ID NO: 1346 - DNA, 21 bp, Artificial Sequence
  Description of Artificial Sequence: Synthetic oligonucleotide
ggtgcattcagtagggccact

SEQ ID NO: 1347 - DNA, 21 bp, Artificial Sequence
  Description of Artificial Sequence: Synthetic oligonucleotide
ggtgcctccaacagggccatt

SEQ ID NO: 1348 - DNA, 21 bp, Artificial Sequence
  Description of Artificial Sequence: Synthetic oligonucleotide
agggatagcaagcggccctct

SEQ ID NO: 1349 - DNA, 21 bp, Artificial Sequence
  Description of Artificial Sequence: Synthetic oligonucleotide
agcgatagcaaccggccctca

SEQ ID NO: 1350 - DNA, 21 bp, Artificial Sequence
  Description of Artificial Sequence: Synthetic oligonucleotide
caagataacgagcggccctca

SEQ ID NO: 1351 - DNA, 21 bp, Artificial Sequence
  Description of Artificial Sequence: Synthetic oligonucleotide
gctgcatccagtttgaaaagt

SEQ ID NO: 1352 - DNA, 21 bp, Artificial Sequence
  Description of Artificial Sequence: Synthetic oligonucleotide
gctgcatccaatttgcaaagt

SEQ ID NO: 1353 - DNA, 21 bp, Artificial Sequence
  Description of Artificial Sequence: Synthetic oligonucleotide
agggataggaaccggccctct

SEQ ID NO: 1354 - DNA, 21 bp, Artificial Sequence
  Description of Artificial Sequence: Synthetic oligonucleotide
actacatccagtttgcaaagt

SEQ ID NO: 1355 - DNA, 21 bp, Artificial Sequence
  Description of Artificial Sequence: Synthetic oligonucleotide
ggtacatccatcagggccagt

SEQ ID NO: 1356 - DNA, 21 bp, Artificial Sequence
  Description of Artificial Sequence: Synthetic oligonucleotide
tgtgatagcaaccggccctca

SEQ ID NO: 1357 - DNA, 21 bp, Artificial Sequence
  Description of Artificial Sequence: Synthetic oligonucleotide
tctgcatccagtttgcaaagt

SEQ ID NO: 1358 - DNA, 21 bp, Artificial Sequence
  Description of Artificial Sequence: Synthetic oligonucleotide
aagggttctaactgggactca

SEQ ID NO: 1359 - DNA, 21 bp, Artificial Sequence
  Description of Artificial Sequence: Synthetic oligonucleotide
ggtacatccaccagggccact

SEQ ID NO: 1360 - DNA, 21 bp, Artificial Sequence
  Description of Artificial Sequence: Synthetic oligonucleotide
ggttcatccaacagggccatt

SEQ ID NO: 1361 - DNA, 21 bp, Artificial Sequence
  Description of Artificial Sequence: Synthetic oligonucleotide
gacaatgataagcgaccctca

SEQ ID NO: 1362 - DNA, 21 bp, Artificial Sequence
  Description of Artificial Sequence: Synthetic oligonucleotide
gcttcatccagtttgcaaagt

SEQ ID NO: 1363 - DNA, 21 bp, Artificial Sequence
  Description of Artificial Sequence: Synthetic oligonucleotide
acgctttcctttcgggcctct

SEQ ID NO: 1364 - DNA, 21 bp, Artificial Sequence
  Description of Artificial Sequence: Synthetic oligonucleotide
gctgcatccactttgctatca

SEQ ID NO: 1365 - DNA, 27 bp, Artificial Sequence
  Description of Artificial Sequence: Synthetic oligonucleotide
caacagagtgacagtatccctcggacg

SEQ ID NO: 1366 - DNA, 27 bp, Artificial Sequence
  Description of Artificial Sequence: Synthetic oligonucleotide
caacagagttacagtgctacattcact

SEQ ID NO: 1367 - DNA, 27 bp, Artificial Sequence
  Description of Artificial Sequence: Synthetic oligonucleotide
catcagagtagtgatttaccgctcact

SEQ ID NO: 1368 - DNA, 27 bp, Artificial Sequence
  Description of Artificial Sequence: Synthetic oligonucleotide
caacagagttacaataccccgtgcagt

SEQ ID NO: 1369 - DNA, 27 bp, Artificial Sequence
  Description of Artificial Sequence: Synthetic oligonucleotide
atgcaacgtatagagtttccgatcacc

SEQ ID NO: 1370 - DNA, 27 bp, Artificial Sequence
  Description of Artificial Sequence: Synthetic oligonucleotide
caacaatatgataatctcccattcact

SEQ ID NO: 1371 - DNA, 27 bp, Artificial Sequence
  Description of Artificial Sequence: Synthetic oligonucleotide
atgcaacatatagaatttccttcgacc

SEQ ID NO: 1372 - DNA, 27 bp, Artificial Sequence
  Description of Artificial Sequence: Synthetic oligonucleotide
caccagtatgatgatctcccgctcact

SEQ ID NO: 1373 - DNA, 27 bp, Artificial Sequence
  Description of Artificial Sequence: Synthetic oligonucleotide
caacagtatgacaatttaccgctcacc

SEQ ID NO: 1374 - DNA, 30 bp, Artificial Sequence
  Description of Artificial Sequence: Synthetic oligonucleotide
cagtcttatgatcgcaacaatcatgtggtt

SEQ ID NO: 1375 - DNA, 33 bp, Artificial Sequence
  Description of Artificial Sequence: Synthetic oligonucleotide
tactcaacagacagcagtgttaatcatgtggta

SEQ ID NO: 1376 - DNA, 27 bp, Artificial Sequence
  Description of Artificial Sequence: Synthetic oligonucleotide
caggcgtgggatagtagtactgcggta

SEQ ID NO: 1377 - DNA, 27 bp, Artificial Sequence
  Description of Artificial Sequence: Synthetic oligonucleotide
ctacaacatagtagttacccgctcact

SEQ ID NO: 1378 - DNA, 30 bp, Artificial Sequence
  Description of Artificial Sequence: Synthetic oligonucleotide
caacagactaacagtttccctccgtggacg

SEQ ID NO: 1379 - DNA, 27 bp, Artificial Sequence
  Description of Artificial Sequence: Synthetic oligonucleotide
cagcagagttacagtaccccgctcact

SEQ ID NO: 1380 - DNA, 27 bp, Artificial Sequence
  Description of Artificial Sequence: Synthetic oligonucleotide
cagcagtataataactggccgctcact

SEQ ID NO: 1381 - DNA, 33 bp, Artificial Sequence
  Description of Artificial Sequence: Synthetic oligonucleotide
ggaacatgggatagcagcctgagtgctgtggta

SEQ ID NO: 1382 - DNA, 27 bp, Artificial Sequence
  Description of Artificial Sequence: Synthetic oligonucleotide
caacagagttccagtatcccttggacg

SEQ ID NO: 1383 - DNA, 27 bp, Artificial Sequence
  Description of Artificial Sequence: Synthetic oligonucleotide
atgcaagctctacaaactccattcact

SEQ ID NO: 1384 - DNA, 27 bp, Artificial Sequence
  Description of Artificial Sequence: Synthetic oligonucleotide
cagcagtatggtagttcacctcgcagt

SEQ ID NO: 1385 - DNA, 27 bp, Artificial Sequence
  Description of Artificial Sequence: Synthetic oligonucleotide
atgcaaggtctacaaactcctcccact

SEQ ID NO: 1386 - DNA, 27 bp, Artificial Sequence
  Description of Artificial Sequence: Synthetic oligonucleotide
ctacagcataagagttacccattcact

SEQ ID NO: 1387 - DNA, 24 bp, Artificial Sequence
  Description of Artificial Sequence: Synthetic oligonucleotide
cagcagtttagtaactcaatcacc

SEQ ID NO: 1388 - DNA, 24 bp, Artificial Sequence
  Description of Artificial Sequence: Synthetic oligonucleotide
cagcagtatggtagctcacggacg

SEQ ID NO: 1389 - DNA, 27 bp, Artificial Sequence
  Description of Artificial Sequence: Synthetic oligonucleotide
caacagtataatatttaccctcggacg

SEQ ID NO: 1390 - DNA, 27 bp, Artificial Sequence
  Description of Artificial Sequence: Synthetic oligonucleotide
atgcaagctctacaaactctcatcacc

SEQ ID NO: 1391 - DNA, 27 bp, Artificial Sequence
  Description of Artificial Sequence: Synthetic oligonucleotide
caggcgtgggacagcggcactgtggta

SEQ ID NO: 1392 - DNA, 30 bp, Artificial Sequence
  Description of Artificial Sequence: Synthetic oligonucleotide
caggtgtgggatagtagtagtgatgtggta

SEQ ID NO: 1393 - DNA, 27 bp, Artificial Sequence
  Description of Artificial Sequence: Synthetic oligonucleotide
caacaatatgctattctcccattcact

SEQ ID NO: 1394 - DNA, 27 bp, Artificial Sequence
  Description of Artificial Sequence: Synthetic oligonucleotide
caacagagttccactatcccttggacg

SEQ ID NO: 1395 - DNA, 27 bp, Artificial Sequence
  Description of Artificial Sequence: Synthetic oligonucleotide
cagcaatatggtagatcactattcact

SEQ ID NO: 1396 - DNA, 27 bp, Artificial Sequence
  Description of Artificial Sequence: Synthetic oligonucleotide
caacaatataatacttaccctcggacg

SEQ ID NO: 1397 - DNA, 27 bp, Artificial Sequence
  Description of Artificial Sequence: Synthetic oligonucleotide
catcagtatggtacctcaccgtgcagt

SEQ ID NO: 1398 - DNA, 33 bp, Artificial Sequence
  Description of Artificial Sequence: Synthetic oligonucleotide
tactcaacagacagcagtggtaatcatgtggta

SEQ ID NO: 1399 - DNA, 30 bp, Artificial Sequence
  Description of Artificial Sequence: Synthetic oligonucleotide
caggcgtgggacagcagcactacatgggtg

SEQ ID NO: 1400 - DNA, 27 bp, Artificial Sequence
  Description of Artificial Sequence: Synthetic oligonucleotide
caggcgtgggacagcgccactgtgatt

SEQ ID NO: 1401 - DNA, 33 bp, Artificial Sequence
  Description of Artificial Sequence: Synthetic oligonucleotide
ggaacatgggacagcagcctgagtgttatggtt

SEQ ID NO: 1402 - DNA, 27 bp, Artificial Sequence
  Description of Artificial Sequence: Synthetic oligonucleotide
atgcaacgtatagagtttccgctcact

SEQ ID NO: 1403 - DNA, 30 bp, Artificial Sequence
  Description of Artificial Sequence: Synthetic oligonucleotide
cagcagtatggtagctcacctccgtggacg

SEQ ID NO: 1404 - DNA, 27 bp, Artificial Sequence
  Description of Artificial Sequence: Synthetic oligonucleotide
caggcgtgggacagcagcacttgggtg

SEQ ID NO: 1405 - DNA, 27 bp, Artificial Sequence
  Description of Artificial Sequence: Synthetic oligonucleotide
ctccagcataatagttaccctctcact

SEQ ID NO: 1406 - DNA, 24 bp, Artificial Sequence
  Description of Artificial Sequence: Synthetic oligonucleotide
cagcagtttggaagctcactcact

SEQ ID NO: 1407 - DNA, 24 bp, Artificial Sequence
  Description of Artificial Sequence: Synthetic oligonucleotide
cagcagtttggtaggtcattcact

SEQ ID NO: 1408 - DNA, 27 bp, Artificial Sequence
  Description of Artificial Sequence: Synthetic oligonucleotide
cagcagtataataactggccgtggacg

SEQ ID NO: 1409 - DNA, 27 bp, Artificial Sequence
  Description of Artificial Sequence: Synthetic oligonucleotide
caacagagttacagtacctcgctcact

SEQ ID NO: 1410 - DNA, 27 bp, Artificial Sequence
  Description of Artificial Sequence: Synthetic oligonucleotide
caggtgtgggacagcagtagtgtggta

SEQ ID NO: 1411 - DNA, 30 bp, Artificial Sequence
  Description of Artificial Sequence: Synthetic oligonucleotide
caggtgtgggacagtagtagtgatggggta

SEQ ID NO: 1412 - DNA, 27 bp, Artificial Sequence
  Description of Artificial Sequence: Synthetic oligonucleotide
caggcgtgggacagcaccactgtggta

SEQ ID NO: 1413 - DNA, 30 bp, Artificial Sequence
  Description of Artificial Sequence: Synthetic oligonucleotide
cagcagtatggtagttcatctctgtgcagt

SEQ ID NO: 1414 - DNA, 27 bp, Artificial Sequence
  Description of Artificial Sequence: Synthetic oligonucleotide
caacaggctaacagtttccctccgacg

SEQ ID NO: 1415 - DNA, 27 bp, Artificial Sequence
  Description of Artificial Sequence: Synthetic oligonucleotide
ctacaacttaatggttaccctctcact

SEQ ID NO: 1416 - DNA, 27 bp, Artificial Sequence
  Description of Artificial Sequence: Synthetic oligonucleotide
cagttgtgggacagcagcactgtggtt

SEQ ID NO: 1417 - DNA, 27 bp, Artificial Sequence
  Description of Artificial Sequence: Synthetic oligonucleotide
caacagagttacagttccccgctcact

SEQ ID NO: 1418 - DNA, 27 bp, Artificial Sequence
  Description of Artificial Sequence: Synthetic oligonucleotide
caacagacttacagtgccccattcact

SEQ ID NO: 1419 - DNA, 33 bp, Artificial Sequence
  Description of Artificial Sequence: Synthetic oligonucleotide
caggtgtgggatagtagtagtgatcatgtggta

SEQ ID NO: 1420 - DNA, 33 bp, Artificial Sequence
  Description of Artificial Sequence: Synthetic oligonucleotide
catgcgtgtgggagcagtagtagcgatggggta

SEQ ID NO: 1421 - DNA, 30 bp, Artificial Sequence
  Description of Artificial Sequence: Synthetic oligonucleotide
caggtgtgggacagtagttgtgatggggta

SEQ ID NO: 1422 - DNA, 30 bp, Artificial Sequence
  Description of Artificial Sequence: Synthetic oligonucleotide
atacaagatacacactggcccacgtgcagt

SEQ ID NO: 1423 - DNA, 27 bp, Artificial Sequence
  Description of Artificial Sequence: Synthetic oligonucleotide
caggtgtgggacagcagcactgtggtc

SEQ ID NO: 1424 - DNA, 27 bp, Artificial Sequence
  Description of Artificial Sequence: Synthetic oligonucleotide
caggtgtgggacagcaaccctgtggta

SEQ ID NO: 1425 - DNA, 21 bp, Artificial Sequence
  Description of Artificial Sequence: Synthetic oligonucleotide
caggcgtgggacagcagggta

SEQ ID NO: 1426 - DNA, 24 bp, Artificial Sequence
  Description of Artificial Sequence: Synthetic oligonucleotide
cagcagtatggtagctcgtgcagt

SEQ ID NO: 1427 - DNA, 27 bp, Artificial Sequence
  Description of Artificial Sequence: Synthetic oligonucleotide
cagcaatataatacctggccgtggacg

SEQ ID NO: 1428 - DNA, 27 bp, Artificial Sequence
  Description of Artificial Sequence: Synthetic oligonucleotide
cagcagtatgaaatttggccgtggacg

SEQ ID NO: 1429 - DNA, 27 bp, Artificial Sequence
  Description of Artificial Sequence: Synthetic oligonucleotide
cagcagtatggtagttcaccgtggacg

SEQ ID NO: 1430 - DNA, 27 bp, Artificial Sequence
  Description of Artificial Sequence: Synthetic oligonucleotide
atgcaacgtctagagtttcctattacc

SEQ ID NO: 1431 - DNA, 27 bp, Artificial Sequence
  Description of Artificial Sequence: Synthetic oligonucleotide
caacagagtttcagtaccccgctcact

SEQ ID NO: 1432 - DNA, 27 bp, Artificial Sequence
  Description of Artificial Sequence: Synthetic oligonucleotide
caggtgtgggacagcagtcctgtggta

SEQ ID NO: 1433 - DNA, 27 bp, Artificial Sequence
  Description of Artificial Sequence: Synthetic oligonucleotide
ctacagcgtaatagttacccgctcact

SEQ ID NO: 1434 - DNA, 27 bp, Artificial Sequence
  Description of Artificial Sequence: Synthetic oligonucleotide
caccagtatactaactggcctcggacg

SEQ ID NO: 1435 - DNA, 27 bp, Artificial Sequence
  Description of Artificial Sequence: Synthetic oligonucleotide
cagcagtatggtacctcaccatttact

SEQ ID NO: 1436 - DNA, 27 bp, Artificial Sequence
  Description of Artificial Sequence: Synthetic oligonucleotide
ctacagcataatagttaccctcggacg

SEQ ID NO: 1437 - DNA, 27 bp, Artificial Sequence
  Description of Artificial Sequence: Synthetic oligonucleotide
caaaagtattacagtgcccctttcact

SEQ ID NO: 1438 - DNA, 27 bp, Artificial Sequence
  Description of Artificial Sequence: Synthetic oligonucleotide
atggaaggtacacactggcctcgggac

SEQ ID NO: 1439 - protein, 8 aa, Artificial Sequence
  Description of Artificial Sequence: Synthetic peptide
QQFGSSLT

SEQ ID NO: 1440 - protein, 9 aa, Artificial Sequence
  Description of Artificial Sequence: Synthetic peptide
QQSYSTSLT

SEQ ID NO: 1441 - protein, 9 aa, Artificial Sequence
  Description of Artificial Sequence: Synthetic peptide
QQSYSSPLT

SEQ ID NO: 1442 - protein, 9 aa, Artificial Sequence
  Description of Artificial Sequence: Synthetic peptide
QQSFSTPLT

SEQ ID NO: 1443 - protein, 9 aa, Artificial Sequence
  Description of Artificial Sequence: Synthetic peptide
  MOD_RES (4)..(4): Tyr or Phe
  MOD_RES (6)..(6): Thr or Ser
  MOD_RES (7)..(7): Pro or Ser
QQSXSXXLT

SEQ ID NO: 1444 - protein, 9 aa, Artificial Sequence
  Description of Artificial Sequence: Synthetic peptide
LQRNSYPLT

SEQ ID NO: 1445 - protein, 9 aa, Artificial Sequence
  Description of Artificial Sequence: Synthetic peptide
LQHNSYPRT

SEQ ID NO: 1446 - protein, 9 aa, Artificial Sequence
  Description of Artificial Sequence: Synthetic peptide
LQHSSYPLT

SEQ ID NO: 1447 - protein, 9 aa, Artificial Sequence
  Description of Artificial Sequence: Synthetic peptide
  MOD_RES (3)..(3): His or Arg
  MOD_RES (4)..(4): Asn or Ser
  MOD_RES (8)..(8): Leu or Arg
LQXXSYPXT

SEQ ID NO: 1448 - protein, 9 aa, Artificial Sequence
  Description of Artificial Sequence: Synthetic peptide
MQRIEFPLT

SEQ ID NO: 1449 - protein, 9 aa, Artificial Sequence
  Description of Artificial Sequence: Synthetic peptide
MQRIEFPIT

SEQ ID NO: 1450 - protein, 9 aa, Artificial Sequence
  Description of Artificial Sequence: Synthetic peptide
MQRLEFPIT

SEQ ID NO: 1451 - protein, 9 aa, Artificial Sequence
  Description of Artificial Sequence: Synthetic peptide
  MOD_RES (4)..(4): Ile or Leu
  MOD_RES (8)..(8): Ile or Leu
MQRXEFPXT

SEQ ID NO: 1452 - protein, 9 aa, Artificial Sequence
  Description of Artificial Sequence: Synthetic peptide
QVWDSNPVV

SEQ ID NO: 1453 - protein, 9 aa, Artificial Sequence
  Description of Artificial Sequence: Synthetic peptide
QLWDSSTVV

SEQ ID NO: 1454 - protein, 9 aa, Artificial Sequence
  Description of Artificial Sequence: Synthetic peptide
QVWDSSSVV

SEQ ID NO: 1455 - protein, 9 aa, Artificial Sequence
  Description of Artificial Sequence: Synthetic peptide
QVWDSSPVV

SEQ ID NO: 1456 - protein, 9 aa, Artificial Sequence
  Description of Artificial Sequence: Synthetic peptide
QVWDSSTVV

SEQ ID NO: 1457 - protein, 9 aa, Artificial Sequence
  Description of Artificial Sequence: Synthetic peptide
  MOD_RES (2)..(2): Val or Leu
  MOD_RES (6)..(6): Ser or Asn
  MOD_RES (7)..(7): Thr, Pro or Ser
QXWDSXXVV

SEQ ID NO: 1458 - protein, 9 aa, Artificial Sequence
  Description of Artificial Sequence: Synthetic peptide
QQYNNWPLT

SEQ ID NO: 1459 - protein, 9 aa, Artificial Sequence
  Description of Artificial Sequence: Synthetic peptide
QQYNNWPWT

SEQ ID NO: 1460 - protein, 9 aa, Artificial Sequence
  Description of Artificial Sequence: Synthetic peptide
QQYNTWPWT

SEQ ID NO: 1461 - protein, 9 aa, Artificial Sequence
  Description of Artificial Sequence: Synthetic peptide
  MOD_RES (5)..(5): Asn or Thr
  MOD_RES (8)..(8): Trp or Leu
QQYNXWPXT

SEQ ID NO: 1462 - protein, 11 aa, Artificial Sequence
  Description of Artificial Sequence: Synthetic peptide
QVWDSSSDHVV

SEQ ID NO: 1463 - protein, 10 aa, Artificial Sequence
  Description of Artificial Sequence: Synthetic peptide
QVWDSSSDVV

SEQ ID NO: 1464 - protein, 10 aa, Artificial Sequence
  Description of Artificial Sequence: Synthetic peptide
QVWDSSCDGV

SEQ ID NO: 1465 - protein, 10 aa, Artificial Sequence
  Description of Artificial Sequence: Synthetic peptide
QVWDSSSDGV

SEQ ID NO: 1466 - protein, 11 aa, Artificial Sequence
  Description of Artificial Sequence: Synthetic peptide
  MOD_RES (7)..(7): Ser or Cys
  MOD_RES (9)..(9): His, Val or Gly
  MOD_RES (11)..(11): May or may not be present
QVWDSSXDXVV

SEQ ID NO: 1467 - protein, 9 aa, Artificial Sequence
  Description of Artificial Sequence: Synthetic peptide
QQSSSIPWT

SEQ ID NO: 1468 - protein, 9 aa, Artificial Sequence
  Description of Artificial Sequence: Synthetic peptide
QQSSTIPWT

SEQ ID NO: 1469 - protein, 9 aa, Artificial Sequence
  Description of Artificial Sequence: Synthetic peptide
  MOD_RES (5)..(5): Ser or Thr
QQSSXIPWT

SEQ ID NO: 1470 - protein, 10 aa, Artificial Sequence
  Description of Artificial Sequence: Synthetic peptide
QQTNSFPPWT

SEQ ID NO: 1471 - protein, 11 aa, Artificial Sequence
  Description of Artificial Sequence: Synthetic peptide
GTWDSSLSAVV

SEQ ID NO: 1472 - protein, 11 aa, Artificial Sequence
  Description of Artificial Sequence: Synthetic peptide
GTWDSSLSVVV

SEQ ID NO: 1473 - protein, 11 aa, Artificial Sequence
  Description of Artificial Sequence: Synthetic peptide
GTWDSSLSAMV

SEQ ID NO: 1474 - protein, 11 aa, Artificial Sequence
  Description of Artificial Sequence: Synthetic peptide
  MOD_RES (9)..(9): Ala or Val
  MOD_RES (10)..(10): Val or Met
GTWDSSLSXXV

SEQ ID NO: 1475 - protein, 9 aa, Artificial Sequence
  Description of Artificial Sequence: Synthetic peptide
QQYDNLPLT

SEQ ID NO: 1476 - protein, 9 aa, Artificial Sequence
  Description of Artificial Sequence: Synthetic peptide
QQYDNLPFT

SEQ ID NO: 1477 - protein, 9 aa, Artificial Sequence
  Description of Artificial Sequence: Synthetic peptide
  MOD_RES (8)..(8): Leu or Phe
QQYDNLPXT

SEQ ID NO: 1478 - protein, 10 aa, Artificial Sequence
  Description of Artificial Sequence: Synthetic peptide
QQYGSSPPWT

SEQ ID NO: 1479 - protein, 9 aa, Artificial Sequence
  Description of Artificial Sequence: Synthetic peptide
QQYGSSPWT

SEQ ID NO: 1480 - protein, 10 aa, Artificial Sequence
  Description of Artificial Sequence: Synthetic peptide
  MOD_RES (7)..(7): May or may not be present
QQYGSSPPWT

SEQ ID NO: 1481 - protein, 9 aa, Artificial Sequence
  Description of Artificial Sequence: Synthetic peptide
QQYGRSLFT

SEQ ID NO: 1482 - protein, 9 aa, Artificial Sequence
  Description of Artificial Sequence: Synthetic peptide
QQYGTSPFT

SEQ ID NO: 1483 - protein, 9 aa, Artificial Sequence
  Description of Artificial Sequence: Synthetic peptide
  MOD_RES (5)..(5): Arg or Thr
  MOD_RES (7)..(7): Leu or Pro
QQYGXSXFT

SEQ ID NO: 1484 - protein, 8 aa, Artificial Sequence
  Description of Artificial Sequence: Synthetic peptide
QQYGSSRS

SEQ ID NO: 1485 - protein, 9 aa, Artificial Sequence
  Description of Artificial Sequence: Synthetic peptide
QQYGSSPRS

SEQ ID NO: 1486 - protein, 8 aa, Artificial Sequence
  Description of Artificial Sequence: Synthetic peptide
QQYGSSRT

SEQ ID NO: 1487 - protein, 8 aa, Artificial Sequence
  Description of Artificial Sequence: Synthetic peptide
QQYGSSCS

SEQ ID NO: 1488 - protein, 9 aa, Artificial Sequence
  Description of Artificial Sequence: Synthetic peptide
  MOD_RES (7)..(7): May or may not be present
  MOD_RES (8)..(8): Arg or Cys
  MOD_RES (9)..(9): Ser or Thr
QQYGSSPXX

SEQ ID NO: 1489 - protein, 10 aa, Artificial Sequence
  Description of Artificial Sequence: Synthetic peptide
QADWSSTTWV

SEQ ID NO: 1490 - protein, 9 aa, Artificial Sequence
  Description of Artificial Sequence: Synthetic peptide
QADWSSTAV

SEQ ID NO: 1491 - protein, 9 aa, Artificial Sequence
  Description of Artificial Sequence: Synthetic peptide
QADWSSTWV

SEQ ID NO: 1492 - protein, 10 aa, Artificial Sequence
  Description of Artificial Sequence: Synthetic peptide
  MOD_RES (7)..(7): May or may not be present
  MOD_RES (9)..(9): Trp or Ala
QAWDSSTTXV

SEQ ID NO: 1493 - protein, 9 aa, Artificial Sequence
  Description of Artificial Sequence: Synthetic peptide
QADWSGTVV

SEQ ID NO: 1494 - protein, 9 aa, Artificial Sequence
  Description of Artificial Sequence: Synthetic peptide
QADWSTTVV

SEQ ID NO: 1495 - protein, 9 aa, Artificial Sequence
  Description of Artificial Sequence: Synthetic peptide
QAWDSATVI

SEQ ID NO: 1496 - protein, 9 aa, Artificial Sequence
  Description of Artificial Sequence: Synthetic peptide
  MOD_RES (6)..(6): Gly, Thr, Ala or not present
  MOD_RES (9)..(9): Val or Ile
QAWDSXTVX

SEQ ID NO: 1497 - protein, 9 aa, Artificial Sequence
  Description of Artificial Sequence: Synthetic peptide
QQSYSATFT

SEQ ID NO: 1498 - protein, 9 aa, Artificial Sequence
  Description of Artificial Sequence: Synthetic peptide
QQTYSAPFT

SEQ ID NO: 1499 - protein, 9 aa, Artificial Sequence
  Description of Artificial Sequence: Synthetic peptide
  MOD_RES (3)..(3): Ser or Thr
  MOD_RES (7)..(7): Thr or Pro
QQXYSAXFT

SEQ ID NO: 1500 - protein, 9 aa, Artificial Sequence
  Description of Artificial Sequence: Synthetic peptide
QQYNIYPRT

SEQ ID NO: 1501 - protein, 9 aa, Artificial Sequence
  Description of Artificial Sequence: Synthetic peptide
QQYNTYPRT

SEQ ID NO: 1502 - protein, 9 aa, Artificial Sequence
  Description of Artificial Sequence: Synthetic peptide
  MOD_RES (5)..(5): Ile or Thr
QQYNXYPRT

SEQ ID NO: 1503 - protein, 9 aa, Artificial Sequence
  Description of Artificial Sequence: Synthetic peptide
HQSSDLPLT

SEQ ID NO: 1504 - protein, 9 aa, Artificial Sequence
  Description of Artificial Sequence: Synthetic peptide
HQYDDLPLT

SEQ ID NO: 1505 - protein, 9 aa, Artificial Sequence
  Description of Artificial Sequence: Synthetic peptide
  MOD_RES (3)..(3): Ser or Tyr
  MOD_RES (4)..(4): Ser or Asp
HQXXDLPLT

SEQ ID NO: 1506 - protein, 9 aa, Artificial Sequence
  Description of Artificial Sequence: Synthetic peptide
MQALQTPFT

SEQ ID NO: 1507 - protein, 9 aa, Artificial Sequence
  Description of Artificial Sequence: Synthetic peptide
MQALQTLIT

SEQ ID NO: 1508 - protein, 9 aa, Artificial Sequence
  Description of Artificial Sequence: Synthetic peptide
  MOD_RES (7)..(7): Pro or Leu
  MOD_RES (8)..(8): Phe or Ile
MQALQTXXT

SEQ ID NO: 1509 - protein, 8 aa, Artificial Sequence
  Description of Artificial Sequence: Synthetic peptide
QQFGRSFT

SEQ ID NO: 1510 - protein, 11 aa, Artificial Sequence
  Description of Artificial Sequence: Synthetic peptide
YSTDSSVNHVV

SEQ ID NO: 1511 - protein, 11 aa, Artificial Sequence
  Description of Artificial Sequence: Synthetic peptide
YSTDSSGNHVV

SEQ ID NO: 1512 - protein, 11 aa, Artificial Sequence
  Description of Artificial Sequence: Synthetic peptide
  MOD_RES (7)..(7): Val or Gly
YSTDSSXNHVV

SEQ ID NO: 1513 - protein, 7 aa, Artificial Sequence
  Description of Artificial Sequence: Synthetic peptide
AASSLQS

SEQ ID NO: 1514 - protein, 7 aa, Artificial Sequence
  Description of Artificial Sequence: Synthetic peptide
SASSLQS

SEQ ID NO: 1515 - protein, 7 aa, Artificial Sequence
  Description of Artificial Sequence: Synthetic peptide
AASSLQF

SEQ ID NO: 1516 - protein, 7 aa, Artificial Sequence
  Description of Artificial Sequence: Synthetic peptide
AASSLKS

SEQ ID NO: 1517 - protein, 7 aa, Artificial Sequence
  Description of Artificial Sequence: Synthetic peptide
  MOD_RES (1)..(1): Ala or Ser
  MOD_RES (6)..(6): Gln or Lys
  MOD_RES (7)..(7): Ser or Phe
XASSLXX

SEQ ID NO: 1518 - protein, 7 aa, Artificial Sequence
  Description of Artificial Sequence: Synthetic peptide
GASSRAT

SEQ ID NO: 1519 - protein, 7 aa, Artificial Sequence
  Description of Artificial Sequence: Synthetic peptide
GASSRDT

SEQ ID NO: 1520 - protein, 7 aa, Artificial Sequence
  Description of Artificial Sequence: Synthetic peptide
GTSTRAT

SEQ ID NO: 1521 - protein, 7 aa, Artificial Sequence
  Description of Artificial Sequence: Synthetic peptide
GASTRAT

SEQ ID NO: 1522 - protein, 7 aa, Artificial Sequence
  Description of Artificial Sequence: Synthetic peptide
GASARAT

SEQ ID NO: 1523 - protein, 7 aa, Artificial Sequence
  Description of Artificial Sequence: Synthetic peptide
GASRRAT

SEQ ID NO: 1524 - protein, 7 aa, Artificial Sequence
  Description of Artificial Sequence: Synthetic peptide
GASNRAT

SEQ ID NO: 1525 - protein, 7 aa, Artificial Sequence
  Description of Artificial Sequence: Synthetic peptide
  MOD_RES (2)..(2): Ala or Thr
  MOD_RES (4)..(4): Ser, Thr, Ala, Arg or Asn
  MOD_RES (6)..(6): Ala or Asp
GXSXRXT

SEQ ID NO: 1526 - protein, 7 aa, Artificial Sequence
  Description of Artificial Sequence: Synthetic peptide
GAFSRAS

SEQ ID NO: 1527 - protein, 7 aa, Artificial Sequence
  Description of Artificial Sequence: Synthetic peptide
GAFSRAT

SEQ ID NO: 1528 - protein, 7 aa, Artificial Sequence
  Description of Artificial Sequence: Synthetic peptide
  MOD_RES (7)..(7): Ser or Thr
GAFSRAX

SEQ ID NO: 1529 - protein, 7 aa, Artificial Sequence
  Description of Artificial Sequence: Synthetic peptide
QDTKRPS

SEQ ID NO: 1530 - protein, 7 aa, Artificial Sequence
  Description of Artificial Sequence: Synthetic peptide
RDSKRPS

SEQ ID NO: 1531 - protein, 7 aa, Artificial Sequence
  Description of Artificial Sequence: Synthetic peptide
EDSKRPS

SEQ ID NO: 1532 - protein, 7 aa, Artificial Sequence
  Description of Artificial Sequence: Synthetic peptide
QDSKRPS

SEQ ID NO: 1533 - protein, 7 aa, Artificial Sequence
  Description of Artificial Sequence: Synthetic peptide
  MOD_RES (1)..(1): Gln, Arg or Glu
  MOD_RES (3)..(3): Thr or Ser
XDXKRPS

SEQ ID NO: 1534 - protein, 7 aa, Artificial Sequence
  Description of Artificial Sequence: Synthetic peptide
TLSYRAS

SEQ ID NO: 1535 - protein, 7 aa, Artificial Sequence
  Description of Artificial Sequence: Synthetic peptide
TLSFRAS

SEQ ID NO: 1536 - protein, 7 aa, Artificial Sequence
  Description of Artificial Sequence: Synthetic peptide
  MOD_RES (4)..(4): Tyr or Phe
TLSXRAS

SEQ ID NO: 1537 - protein, 7 aa, Artificial Sequence
  Description of Artificial Sequence: Synthetic peptide
AASNLQR

SEQ ID NO: 1538 - protein, 7 aa, Artificial Sequence
  Description of Artificial Sequence: Synthetic peptide
AASNLQS

SEQ ID NO: 1539 - protein, 7 aa, Artificial Sequence
  Description of Artificial Sequence: Synthetic peptide
  MOD_RES (7)..(7): Arg or Ser
AASNLQX

SEQ ID NO: 1540 - protein, 7 aa, Artificial Sequence
  Description of Artificial Sequence: Synthetic peptide
GASNRAI

SEQ ID NO: 1541 - protein, 7 aa, Artificial Sequence
  Description of Artificial Sequence: Synthetic peptide
GSSNRAI

SEQ ID NO: 1542 - protein, 7 aa, Artificial Sequence
  Description of Artificial Sequence: Synthetic peptide
GSSNRAT

SEQ ID NO: 1543 - protein, 7 aa, Artificial Sequence
  Description of Artificial Sequence: Synthetic peptide
  MOD_RES (2)..(2): Ala or Ser
  MOD_RES (7)..(7): Ile or Thr
GXSNRAX

SEQ ID NO: 1544 - protein, 7 aa, Artificial Sequence
  Description of Artificial Sequence: Synthetic peptide
DASSLQS

SEQ ID NO: 1545 - protein, 7 aa, Artificial Sequence
  Description of Artificial Sequence: Synthetic peptide
DASTLQS

SEQ ID NO: 1546 - protein, 7 aa, Artificial Sequence
  Description of Artificial Sequence: Synthetic peptide
GASSLQS

SEQ ID NO: 1547 - protein, 7 aa, Artificial Sequence
  Description of Artificial Sequence: Synthetic peptide
GASNLQS

SEQ ID NO: 1548 - protein, 7 aa, Artificial Sequence
  Description of Artificial Sequence: Synthetic peptide
  MOD_RES (1)..(1): Asp or Gly
  MOD_RES (4)..(4): Ser, Thr or Asn
XASXLQS

SEQ ID NO: 1549 - protein, 7 aa, Artificial Sequence
  Description of Artificial Sequence: Synthetic peptide
DNNKRPS

SEQ ID NO: 1550 - protein, 7 aa, Artificial Sequence
  Description of Artificial Sequence: Synthetic peptide
DNDKRPS

SEQ ID NO: 1551 - protein, 7 aa, Artificial Sequence
  Description of Artificial Sequence: Synthetic peptide
  MOD_RES (3)..(3): Asn or Asp
DNXKRPS

SEQ ID NO: 1552 - protein, 7 aa, Artificial Sequence
  Description of Artificial Sequence: Synthetic peptide
DASNLET

SEQ ID NO: 1553 - protein, 7 aa, Artificial Sequence
  Description of Artificial Sequence: Synthetic peptide
DVSNLET

SEQ ID NO: 1554 - protein, 7 aa, Artificial Sequence
  Description of Artificial Sequence: Synthetic peptide
  MOD_RES (2)..(2): Ala or Val
DXSNLET

SEQ ID NO: 1555 - protein, 7 aa, Artificial Sequence
  Description of Artificial Sequence: Synthetic peptide
LGSNRAS

SEQ ID NO: 1556 - protein, 7 aa, Artificial Sequence
  Description of Artificial Sequence: Synthetic peptide
LDSNRAS

SEQ ID NO: 1557 - protein, 7 aa, Artificial Sequence
  Description of Artificial Sequence: Synthetic peptide
  MOD_RES (2)..(2): Gly or Asp
LXSNRAS

SEQ ID NO: 1558 - protein, 7 aa, Artificial Sequence
  Description of Artificial Sequence: Synthetic peptide
QDNKRPS

SEQ ID NO: 1559 - protein, 7 aa, Artificial Sequence
  Description of Artificial Sequence: Synthetic peptide
QNNKRPS

SEQ ID NO: 1560 - protein, 7 aa, Artificial Sequence
  Description of Artificial Sequence: Synthetic peptide
QDNERPS

SEQ ID NO: 1561 - protein, 7 aa, Artificial Sequence
  Description of Artificial Sequence: Synthetic peptide
  MOD_RES (2)..(2): Asp or Asn
  MOD_RES (4)..(4): Lys or Glu
QXNXRPS

SEQ ID NO: 1562 - protein, 7 aa, Artificial Sequence
  Description of Artificial Sequence: Synthetic peptide
RDRNRPS

SEQ ID NO: 1563 - protein, 7 aa, Artificial Sequence
  Description of Artificial Sequence: Synthetic peptide
SDSNRPS

SEQ ID NO: 1564 - protein, 7 aa, Artificial Sequence
  Description of Artificial Sequence: Synthetic peptide
CDSNRPS

SEQ ID NO: 1565 - protein, 7 aa, Artificial Sequence
  Description of Artificial Sequence: Synthetic peptide
  MOD_RES (1)..(1): Ser or Cys
XDSNRPS

SEQ ID NO: 1566 - protein, 7 aa, Artificial Sequence
  Description of Artificial Sequence: Synthetic peptide
DDSDRPS

SEQ ID NO: 1567 - protein, 7 aa, Artificial Sequence
  Description of Artificial Sequence: Synthetic peptide
AVSSLQS

SEQ ID NO: 1568 - protein, 7 aa, Artificial Sequence
  Description of Artificial Sequence: Synthetic peptide
ASSSLQS

SEQ ID NO: 1569 - protein, 7 aa, Artificial Sequence
  Description of Artificial Sequence: Synthetic peptide
  MOD_RES (2)..(2): Ser or Val
AXSSLQS

SEQ ID NO: 1570 - protein, 7 aa, Artificial Sequence
  Description of Artificial Sequence: Synthetic peptide
TASSLQS

SEQ ID NO: 1571 - protein, 7 aa, Artificial Sequence
  Description of Artificial Sequence: Synthetic peptide
TTSSLQS

SEQ ID NO: 1572 - protein, 7 aa, Artificial Sequence
  Description of Artificial Sequence: Synthetic peptide
  MOD_RES (2)..(2): Ala or Thr
TXSSLQS

SEQ ID NO: 1573 - protein, 7 aa, Artificial Sequence
  Description of Artificial Sequence: Synthetic peptide
KVSNWDS

SEQ ID NO: 1574 - protein, 7 aa, Artificial Sequence
  Description of Artificial Sequence: Synthetic peptide
KGSNWDS

SEQ ID NO: 1575 - protein, 7 aa, Artificial Sequence
  Description of Artificial Sequence: Synthetic peptide
  MOD_RES (2)..(2): Val or Gly
KXSNWDS

SEQ ID NO: 1576 - protein, 11 aa, Artificial Sequence
  Description of Artificial Sequence: Synthetic peptide
RASQSVSDILA

SEQ ID NO: 1577 - protein, 12 aa, Artificial Sequence
  Description of Artificial Sequence: Synthetic peptide
RASPSVSSSYLA

SEQ ID NO: 1578 - protein, 12 aa, Artificial Sequence
  Description of Artificial Sequence: Synthetic peptide
RASQSFSSSYLA

SEQ ID NO: 1579 - protein, 12 aa, Artificial Sequence
  Description of Artificial Sequence: Synthetic peptide
RASQSVSRSHLA

SEQ ID NO: 1580 - protein, 12 aa, Artificial Sequence
  Description of Artificial Sequence: Synthetic peptide
RASQSVSRDYLA

SEQ ID NO: 1581 - protein, 12 aa, Artificial Sequence
  Description of Artificial Sequence: Synthetic peptide
RASQSVSRNYLA

SEQ ID NO: 1582 - protein, 12 aa, Artificial Sequence
  Description of Artificial Sequence: Synthetic peptide
RASQSVSSMYLA

SEQ ID NO: 1583 - protein, 11 aa, Artificial Sequence
  Description of Artificial Sequence: Synthetic peptide
RASQSVSSQLA

SEQ ID NO: 1584 - protein, 11 aa, Artificial Sequence
  Description of Artificial Sequence: Synthetic peptide
RASQSISSNLA

SEQ ID NO: 1585 - protein, 11 aa, Artificial Sequence
  Description of Artificial Sequence: Synthetic peptide
RASQSVSSNLA

SEQ ID NO: 1586 - protein, 11 aa, Artificial Sequence
  Description of Artificial Sequence: Synthetic peptide
RASQSVSSNVA

SEQ ID NO: 1587 - protein, 11 aa, Artificial Sequence
  Description of Artificial Sequence: Synthetic peptide
RASQSVNSNLA

SEQ ID NO: 1588 - protein, 12 aa, Artificial Sequence
  Description of Artificial Sequence: Synthetic peptide
RASQSVRSSSLA

SEQ ID NO: 1589 - protein, 12 aa, Artificial Sequence
  Description of Artificial Sequence: Synthetic peptide
RASQSVSNSSLA

SEQ ID NO: 1590 - protein, 12 aa, Artificial Sequence
  Description of Artificial Sequence: Synthetic peptide
RASQSVRNSSLA

SEQ ID NO: 1591 - protein, 12 aa, Artificial Sequence
  Description of Artificial Sequence: Synthetic peptide
  MOD_RES (4)..(4): Pro or Gln
  MOD_RES (6)..(6): Val, Ile or Phe
  MOD_RES (7)..(7): Ser, Arg or not present
  MOD_RES (8)..(8): Ser, Arg or Asn
  MOD_RES (9)..(9): Asp, Ser, Asn or Met
  MOD_RES (10)..(10): Ile, Tyr, His, Gln, Asn or Ser
  MOD_RES (11)..(11): Leu or Val
RASXSXXXXXXA

SEQ ID NO: 1592 - protein, 11 aa, Artificial Sequence
  Description of Artificial Sequence: Synthetic peptide
RASQIISRYLN

SEQ ID NO: 1593 - protein, 11 aa, Artificial Sequence
  Description of Artificial Sequence: Synthetic peptide
RTSQSISSYLN

SEQ ID NO: 1594 - protein, 11 aa, Artificial Sequence
  Description of Artificial Sequence: Synthetic peptide
RASQSISNYLN

SEQ ID NO: 1595 - protein, 11 aa, Artificial Sequence
  Description of Artificial Sequence: Synthetic peptide
RTSQSISSYLN

SEQ ID NO: 1596 - protein, 11 aa, Artificial Sequence
  Description of Artificial Sequence: Synthetic peptide
RASQTISIYLN

SEQ ID NO: 1597 - protein, 11 aa, Artificial Sequence
  Description of Artificial Sequence: Synthetic peptide
RASQRISSYLN

SEQ ID NO: 1598 - protein, 11 aa, Artificial Sequence
  Description of Artificial Sequence: Synthetic peptide
RASQSISSYLN

SEQ ID NO: 1599 - protein, 11 aa, Artificial Sequence
  Description of Artificial Sequence: Synthetic peptide
RASQNIRTYLN

SEQ ID NO: 1600 - protein, 11 aa, Artificial Sequence
  Description of Artificial Sequence: Synthetic peptide
RASQNIRSYLN

SEQ ID NO: 1601 - protein, 11 aa, Artificial Sequence
  Description of Artificial Sequence: Synthetic peptide
RASQNINNYLN

SEQ ID NO: 1602 - protein, 11 aa, Artificial Sequence
  Description of Artificial Sequence: Synthetic peptide
  MOD_RES (2)..(2): Ala or Thr
  MOD_RES (5)..(5): Ile, Ser, Thr or Asn
  MOD_RES (7)..(7): Arg, Ser or Asn
  MOD_RES (8)..(8): Arg, Ser, Asn or Ile
RXSQXIXXYLN

SEQ ID NO: 1603 - protein, 11 aa, Artificial Sequence
  Description of Artificial Sequence: Synthetic peptide
GGNNIGSYNVH

SEQ ID NO: 1604 - protein, 11 aa, Artificial Sequence
  Description of Artificial Sequence: Synthetic peptide
GGNNIGSINVH

SEQ ID NO: 1605 - protein, 11 aa, Artificial Sequence
  Description of Artificial Sequence: Synthetic peptide
GGNNIGSKSVQ

SEQ ID NO: 1606 - protein, 11 aa, Artificial Sequence
  Description of Artificial Sequence: Synthetic peptide
GGNDIGSKSVH

SEQ ID NO: 1607 - protein, 11 aa, Artificial Sequence
  Description of Artificial Sequence: Synthetic peptide
GGNNIGSKSVH

SEQ ID NO: 1608 - protein, 11 aa, Artificial Sequence
  Description of Artificial Sequence: Synthetic peptide
GGNNIGSKTVH

SEQ ID NO: 1609 - protein, 11 aa, Artificial Sequence
  Description of Artificial Sequence: Synthetic peptide
GGNNIGSKAVH

SEQ ID NO: 1610 - protein, 11 aa, Artificial Sequence
  Description of Artificial Sequence: Synthetic peptide
GGNNIGSKNVH

SEQ ID NO: 1611 - protein, 11 aa, Artificial Sequence
  Description of Artificial Sequence: Synthetic peptide
GGNDIGSKNVH

SEQ ID NO: 1612 - protein, 11 aa, Artificial Sequence
  Description of Artificial Sequence: Synthetic peptide
  MOD_RES (4)..(4): Asn or Asp
  MOD_RES (8)..(8): Tyr, Ile or Lys
  MOD_RES (9)..(9): Asn, Ser, Thr or Ala
  MOD_RES (11)..(11): His or Gln
GGNXIGSXXVX

SEQ ID NO: 1613 - protein, 11 aa, Artificial Sequence
  Description of Artificial Sequence: Synthetic peptide
RASQDIRNDLG

SEQ ID NO: 1614 - protein, 11 aa, Artificial Sequence
  Description of Artificial Sequence: Synthetic peptide
RASQDIRNDLA

SEQ ID NO: 1615 - protein, 11 aa, Artificial Sequence
  Description of Artificial Sequence: Synthetic peptide
RASQGIRNDLG

SEQ ID NO: 1616 - protein, 11 aa, Artificial Sequence
  Description of Artificial Sequence: Synthetic peptide
  MOD_RES (5)..(5): Asp or Gly
  MOD_RES (11)..(11): Gly or Ala
RASQXIRNDLX

SEQ ID NO: 1617 - protein, 17 aa, Artificial Sequence
  Description of Artificial Sequence: Synthetic peptide
RSSQSLLNSDAGTTYLD

SEQ ID NO: 1618 - protein, 17 aa, Artificial Sequence
  Description of Artificial Sequence: Synthetic peptide
RSSQSLFDNDDGDTYLD

SEQ ID NO: 1619 - protein, 17 aa, Artificial Sequence
  Description of Artificial Sequence: Synthetic peptide
RSSQSLLNSDDGNTYLD

SEQ ID NO: 1620 - protein, 17 aa, Artificial Sequence
  Description of Artificial Sequence: Synthetic peptide
RSSQSLLDSDDGDTYLD

SEQ ID NO: 1621 - protein, 17 aa, Artificial Sequence
  Description of Artificial Sequence: Synthetic peptide
RSSQSLLDSDDGNTYLD

SEQ ID NO: 1622 - protein, 17 aa, Artificial Sequence
  Description of Artificial Sequence: Synthetic peptide
  MOD_RES (7)..(7): Leu or Phe
  MOD_RES (8)..(8): Asn or Asp
  MOD_RES (9)..(9): Ser or Asn
  MOD_RES (11)..(11): Ala or Asp
  MOD_RES (13)..(13): Thr, Asp or Asn
RSSQSLXXXDXGXTYLD

SEQ ID NO: 1623 - protein, 11 aa, Artificial Sequence
  Description of Artificial Sequence: Synthetic peptide
SGNKLGDKYVC

SEQ ID NO: 1624 - protein, 11 aa, Artificial Sequence
  Description of Artificial Sequence: Synthetic peptide
SGDKLGDKYVC

SEQ ID NO: 1625 - protein, 11 aa, Artificial Sequence
  Description of Artificial Sequence: Synthetic peptide
SGDKLGDKYAC

SEQ ID NO: 1626 - protein, 11 aa, Artificial Sequence
  Description of Artificial Sequence: Synthetic peptide
SGDELGDKYAC

SEQ ID NO: 1627 - protein, 11 aa, Artificial Sequence
  Description of Artificial Sequence: Synthetic peptide
SGDNLGDKYAF

SEQ ID NO: 1628 - protein, 11 aa, Artificial Sequence
  Description of Artificial Sequence: Synthetic peptide
SGDNLGDKYAC

SEQ ID NO: 1629 - protein, 11 aa, Artificial Sequence
  Description of Artificial Sequence: Synthetic peptide
  MOD_RES (3)..(3): Asn or Asp
  MOD_RES (4)..(4): Lys, Glu or Asn
  MOD_RES (10)..(10): Val or Ala
  MOD_RES (11)..(11): Cys or Phe
SGXXLGDKYXX

SEQ ID NO: 1630 - protein, 11 aa, Artificial Sequence
  Description of Artificial Sequence: Synthetic peptide
QASQGISNYLN

SEQ ID NO: 1631 - protein, 11 aa, Artificial Sequence
  Description of Artificial Sequence: Synthetic peptide
QASQDIKKFLN

SEQ ID NO: 1632 - protein, 11 aa, Artificial Sequence
  Description of Artificial Sequence: Synthetic peptide
QASQDINIYLN

SEQ ID NO: 1633 - protein, 11 aa, Artificial Sequence
  Description of Artificial Sequence: Synthetic peptide
QASQDISIYLN

SEQ ID NO: 1634 - protein, 11 aa, Artificial Sequence
  Description of Artificial Sequence: Synthetic peptide
QASQDITKYLN

SEQ ID NO: 1635 - protein, 11 aa, Artificial Sequence
  Description of Artificial Sequence: Synthetic peptide
  MOD_RES (5)..(5): Gly or Asp
  MOD_RES (7)..(7): Ser, Lys, Asn or Thr
  MOD_RES (8)..(8): Asn, Lys or Ile
  MOD_RES (9)..(9): Tyr or Phe
QASQXIXXXLN

SEQ ID NO: 1636 - protein, 11 aa, Artificial Sequence
  Description of Artificial Sequence: Synthetic peptide
RASQDIDSWLV

SEQ ID NO: 1637 - protein, 11 aa, Artificial Sequence
  Description of Artificial Sequence: Synthetic peptide
RASQGISRWLA

SEQ ID NO: 1638 - protein, 11 aa, Artificial Sequence
  Description of Artificial Sequence: Synthetic peptide
RASQDISSWLA

SEQ ID NO: 1639 - protein, 11 aa, Artificial Sequence
  Description of Artificial Sequence: Synthetic peptide
RASQGISSWLA

SEQ ID NO: 1640 - protein, 11 aa, Artificial Sequence
  Description of Artificial Sequence: Synthetic peptide
  MOD_RES (5)..(5): Asp or Gly
  MOD_RES (7)..(7): Asp or Ser
  MOD_RES (8)..(8): Arg or Ser
  MOD_RES (11)..(11): Val or Ala
RASQXIXXWLX

SEQ ID NO: 1641 - protein, 13 aa, Artificial Sequence
  Description of Artificial Sequence: Synthetic peptide
SGSSSNIGNNYVA

SEQ ID NO: 1642 - protein, 13 aa, Artificial Sequence
  Description of Artificial Sequence: Synthetic peptide
SGSSSNIGINYVS

SEQ ID NO: 1643 - protein, 13 aa, Artificial Sequence
  Description of Artificial Sequence: Synthetic peptide
SGSSSNIGDNYVS

SEQ ID NO: 1644 - protein, 13 aa, Artificial Sequence
  Description of Artificial Sequence: Synthetic peptide
SGSSSNIGNNYVS

SEQ ID NO: 1645 - protein, 13 aa, Artificial Sequence
  Description of Artificial Sequence: Synthetic peptide
  MOD_RES (9)..(9): Asn, Ile or Asp
  MOD_RES (13)..(13): Ala or Ser
SGSSSNIGXNYVX

SEQ ID NO: 1646 - protein, 11 aa, Artificial Sequence
  Description of Artificial Sequence: Synthetic peptide
RASQDISNYLA

SEQ ID NO: 1647 - protein, 11 aa, Artificial Sequence
  Description of Artificial Sequence: Synthetic peptide
RASHDISNYLA

SEQ ID NO: 1648 - protein, 11 aa, Artificial Sequence
  Description of Artificial Sequence: Synthetic peptide
  MOD_RES (4)..(4): Gln or His
RASXDISNYLA

SEQ ID NO: 1649 - protein, 12 aa, Artificial Sequence
  Description of Artificial Sequence: Synthetic peptide
RASQRVPSSYIV

SEQ ID NO: 1650 - protein, 12 aa, Artificial Sequence
  Description of Artificial Sequence: Synthetic peptide
RASQRVPSSYLV

SEQ ID NO: 1651 - protein, 12 aa, Artificial Sequence
  Description of Artificial Sequence: Synthetic peptide
RASQSVASSYLV

SEQ ID NO: 1652 - protein, 12 aa, Artificial Sequence
  Description of Artificial Sequence: Synthetic peptide
  MOD_RES (5)..(5): Arg or Ser
  MOD_RES (7)..(7): Pro or Ala
  MOD_RES (11)..(11): Ile or Leu
RASQXVXSSYXV

SEQ ID NO: 1653 - protein, 16 aa, Artificial Sequence
  Description of Artificial Sequence: Synthetic peptide
RSSQSLLHSNGYNYLD

SEQ ID NO: 1654 - protein, 16 aa, Artificial Sequence
  Description of Artificial Sequence: Synthetic peptide
RSSQSLLHSNGFNYLD

SEQ ID NO: 1655 - protein, 16 aa, Artificial Sequence
  Description of Artificial Sequence: Synthetic peptide
RSSQSLQHSNGYNYLD

SEQ ID NO: 1656 - protein, 16 aa, Artificial Sequence
  Description of Artificial Sequence: Synthetic peptide
  MOD_RES (7)..(7): Leu or Gln
  MOD_RES (12)..(12): Tyr or Phe
RSSQSLXHSNGXNYLD

SEQ ID NO: 1657 - protein, 12 aa, Artificial Sequence
  Description of Artificial Sequence: Synthetic peptide
RASQTVRNNYLA

SEQ ID NO: 1658 - protein, 12 aa, Artificial Sequence
  Description of Artificial Sequence: Synthetic peptide
RASQTIRNSYLA

SEQ ID NO: 1659 - protein, 12 aa, Artificial Sequence
  Description of Artificial Sequence: Synthetic peptide
  MOD_RES (6)..(6): Val or Ile
  MOD_RES (9)..(9): Asn or Ser
RASQTXRNXYLA

SEQ ID NO: 1660 - protein, 16 aa, Artificial Sequence
  Description of Artificial Sequence: Synthetic peptide
RSSQRLVYSDGNTYLN

SEQ ID NO: 1661 - protein, 16 aa, Artificial Sequence
  Description of Artificial Sequence: Synthetic peptide
RSSPSLVYSDGNTYLN

SEQ ID NO: 1662 - protein, 16 aa, Artificial Sequence
  Description of Artificial Sequence: Synthetic peptide
  MOD_RES (4)..(4): Gln or Pro
  MOD_RES (5)..(5): Arg or Ser
RSSXXLVYSDGNTYLN

SEQ ID NO: 1663 - protein, 11 aa, Artificial Sequence
  Description of Artificial Sequence: Synthetic peptide
SGDALPKKYAY

SEQ ID NO: 1664 - protein, 11 aa, Artificial Sequence
  Description of Artificial Sequence: Synthetic peptide
SGDAVPKKYAN

SEQ ID NO: 1665 - protein, 11 aa, Artificial Sequence
  Description of Artificial Sequence: Synthetic peptide
  MOD_RES (5)..(5): Leu or Val
  MOD_RES (11)..(11): Tyr or Asn
SGDAXPKKYAX

SEQ ID NO: 1666 - protein, 10 aa, Artificial Sequence
  Description of Artificial Sequence: Synthetic peptide
MTTPYWYFDL

SEQ ID NO: 1667 - protein, 10 aa, Artificial Sequence
  Description of Artificial Sequence: Synthetic peptide
MTSPYWYFDL

SEQ ID NO: 1668 - protein, 10 aa, Artificial Sequence
  Description of Artificial Sequence: Synthetic peptide
MTTPYWYFGL

SEQ ID NO: 1669 - protein, 10 aa, Artificial Sequence
  Description of Artificial Sequence: Synthetic peptide
  MOD_RES (3)..(3): Thr or Ser
  MOD_RES (9)..(9): Asp or Gly
MTXPYWYFXL

SEQ ID NO: 1670 - protein, 20 aa, Artificial Sequence
  Description of Artificial Sequence: Synthetic peptide
DRYYDFWSGYPYFRYYGLDV

SEQ ID NO: 1671 - protein, 20 aa, Artificial Sequence
  Description of Artificial Sequence: Synthetic peptide
DQYFDFWSGYPFFYYYGMDV

SEQ ID NO: 1672 - protein, 20 aa, Artificial Sequence
  Description of Artificial Sequence: Synthetic peptide
DQDYDFWSGYPYFYYYGMDV

SEQ ID NO: 1673 - protein, 20 aa, Artificial Sequence
  Description of Artificial Sequence: Synthetic peptide
DQNYDFWNGYPYYFYYGMDV

SEQ ID NO: 1674 - protein, 20 aa, Artificial Sequence
  Description of Artificial Sequence: Synthetic peptide
DQYYDFWSGYPYYHYYGMDV

SEQ ID NO: 1675 - protein, 20 aa, Artificial Sequence
  Description of Artificial Sequence: Synthetic peptide
  MOD_RES (2)..(2): Arg or Gln
  MOD_RES (3)..(3): Tyr, Asp or Asn
  MOD_RES (4)..(4): Tyr or Phe
  MOD_RES (8)..(8): Ser or Asn
  MOD_RES (12)..(12): Tyr or Phe
  MOD_RES (13)..(13): Phe or Tyr
  MOD_RES (14)..(14): Arg, Tyr, Phe or His
  MOD_RES (18)..(18): Leu or Met
DXXXDFWXGYPXXXYYGXDV

SEQ ID NO: 1676 - protein, 9 aa, Artificial Sequence
  Description of Artificial Sequence: Synthetic peptide
VTGTDAFDF

SEQ ID NO: 1677 - protein, 14 aa, Artificial Sequence
  Description of Artificial Sequence: Synthetic peptide
TVTKEDYYYYGMDV

SEQ ID NO: 1678 - protein, 14 aa, Artificial Sequence
  Description of Artificial Sequence: Synthetic peptide
DSSGSYYVEDYFDY

SEQ ID NO: 1679 - protein, 12 aa, Artificial Sequence
  Description of Artificial Sequence: Synthetic peptide
DWSIAVAGTFDY

SEQ ID NO: 1680 - protein, 12 aa, Artificial Sequence
  Description of Artificial Sequence: Synthetic peptide
DLRIAVAGSFDY

SEQ ID NO: 1681 - protein, 12 aa, Artificial Sequence
  Description of Artificial Sequence: Synthetic peptide
  MOD_RES (2)..(2): Trp or Leu
  MOD_RES (3)..(3): Ser or Arg
  MOD_RES (9)..(9): Thr or Ser
DXXIAVAGXFDY

SEQ ID NO: 1682 - protein, 11 aa, Artificial Sequence
  Description of Artificial Sequence: Synthetic peptide
EYYYGSGSYYP

SEQ ID NO: 1683 - protein, 10 aa, Artificial Sequence
  Description of Artificial Sequence: Synthetic peptide
ELGDYPFFDY

SEQ ID NO: 1684 - protein, 10 aa, Artificial Sequence
  Description of Artificial Sequence: Synthetic peptide
EYVAEAGFDY

SEQ ID NO: 1685 - protein, 10 aa, Artificial Sequence
  Description of Artificial Sequence: Synthetic peptide
VAAVYWYFDL

SEQ ID NO: 1686 - protein, 10 aa, Artificial Sequence
  Description of Artificial Sequence: Synthetic peptide
YNWNYGAFDF

SEQ ID NO: 1687 - protein, 14 aa, Artificial Sequence
  Description of Artificial Sequence: Synthetic peptide
RASRGYRFGLAFAI

SEQ ID NO: 1688 - protein, 14 aa, Artificial Sequence
  Description of Artificial Sequence: Synthetic peptide
RASRGYRYGLAFAI

SEQ ID NO: 1689 - protein, 14 aa, Artificial Sequence
  Description of Artificial Sequence: Synthetic peptide
  MOD_RES (8)..(8): Phe or Tyr
RASRGYRXGLAFAI

SEQ ID NO: 1690 - protein, 17 aa, Artificial Sequence
  Description of Artificial Sequence: Synthetic peptide
DGITMVRGVTHYYGMDV

SEQ ID NO: 1691 - protein, 13 aa, Artificial Sequence
  Description of Artificial Sequence: Synthetic peptide
DHSSGWYYYGMDV

SEQ ID NO: 1692 - protein, 13 aa, Artificial Sequence
  Description of Artificial Sequence: Synthetic peptide
DHTSCWYYYGMDV

SEQ ID NO: 1693 - protein, 13 aa, Artificial Sequence
  Description of Artificial Sequence: Synthetic peptide
  MOD_RES (3)..(3): Ser or Thr
DHXSCWYYYGMDV

SEQ ID NO: 1694 - protein, 12 aa, Artificial Sequence
  Description of Artificial Sequence: Synthetic peptide
YSTWDYYYGVDV

SEQ ID NO: 1695 - protein, 12 aa, Artificial Sequence
  Description of Artificial Sequence: Synthetic peptide
YRDWDYYYGMDV

SEQ ID NO: 1696 - protein, 12 aa, Artificial Sequence
  Description of Artificial Sequence: Synthetic peptide
  MOD_RES (2)..(2): Ser or Arg
  MOD_RES (3)..(3): Thr or Asp
  MOD_RES (10)..(10): Val or Met
YXXWDYYYGXDV

SEQ ID NO: 1697 - protein, 16 aa, Artificial Sequence
  Description of Artificial Sequence: Synthetic peptide
VLHYSDSRGYSYYSDF

SEQ ID NO: 1698 - protein, 16 aa, Artificial Sequence
  Description of Artificial Sequence: Synthetic peptide
VLHYYDSSGYSYYFDY

SEQ ID NO: 1699 - protein, 16 aa, Artificial Sequence
  Description of Artificial Sequence: Synthetic peptide
  MOD_RES (5)..(5): Ser or Tyr
  MOD_RES (8)..(8): Arg or Ser
  MOD_RES (14)..(14): Ser or Phe
  MOD_RES (16)..(16): Phe or Tyr
VLHYXDSXGYSYYXDX

SEQ ID NO: 1700 - protein, 16 aa, Artificial Sequence
  Description of Artificial Sequence: Synthetic peptide
NIYYSGTTYFNPSLKS

SEQ ID NO: 1701 - protein, 16 aa, Artificial Sequence
  Description of Artificial Sequence: Synthetic peptide
FIYYSGGTNYNPSLKS

SEQ ID NO: 1702 - protein, 16 aa, Artificial Sequence
  Description of Artificial Sequence: Synthetic peptide
YIYYSGGTHYNPSLKS

SEQ ID NO: 1703 - protein, 16 aa, Artificial Sequence
  Description of Artificial Sequence: Synthetic peptide
YIYHSGSAYYNPSLKS

SEQ ID NO: 1704 - protein, 16 aa, Artificial Sequence
  Description of Artificial Sequence: Synthetic peptide
YIYDSGSTYYNPSLKS

SEQ ID NO: 1705 - protein, 16 aa, Artificial Sequence
  Description of Artificial Sequence: Synthetic peptide
SIYYSGTTYYNPSLKS

SEQ ID NO: 1706 - protein, 16 aa, Artificial Sequence
  Description of Artificial Sequence: Synthetic peptide
MIYYSGTTYYNPSLKS

SEQ ID NO: 1707 - protein, 16 aa, Artificial Sequence
  Description of Artificial Sequence: Synthetic peptide
YIYYSGTTYYNPSLKS

SEQ ID NO: 1708 - protein, 16 aa, Artificial Sequence
  Description of Artificial Sequence: Synthetic peptide
YIYYSGSAYYNPSLKS

SEQ ID NO: 1709 - protein, 16 aa, Artificial Sequence
  Description of Artificial Sequence: Synthetic peptide
YIFYSGSTYYNPSLKS

SEQ ID NO: 1710 - protein, 16 aa, Artificial Sequence
  Description of Artificial Sequence: Synthetic peptide
YLYYSGSTYYNPSLKS

SEQ ID NO: 1711 - protein, 16 aa, Artificial Sequence
  Description of Artificial Sequence: Synthetic peptide
YIYYSGSTYYNPSLKS

SEQ ID NO: 1712 - protein, 16 aa, Artificial Sequence
  Description of Artificial Sequence: Synthetic peptide
YIYYTGSTYYNPSLKS

SEQ ID NO: 1713 - protein, 16 aa, Artificial Sequence
  Description of Artificial Sequence: Synthetic peptide
YIYYTGSTNYNPSLKS

SEQ ID NO: 1714 - protein, 16 aa, Artificial Sequence
  Description of Artificial Sequence: Synthetic peptide
YIYYSGNTNYNPSLKS

SEQ ID NO: 1715 - protein, 16 aa, Artificial Sequence
  Description of Artificial Sequence: Synthetic peptide
YIYYSGSTNYNPSLKS

SEQ ID NO: 1716 - protein, 16 aa, Artificial Sequence
  Description of Artificial Sequence: Synthetic peptide
  MOD_RES (1)..(1): Asn, Phe, Tyr, Ser or Met
  MOD_RES (2)..(2): Ile or Leu
  MOD_RES (3)..(3): Tyr or Phe
  MOD_RES (4)..(4): Tyr, His or Asp
  MOD_RES (5)..(5): Ser or Thr
  MOD_RES (7)..(7): Thr, Gly, Ser or Thr
  MOD_RES (8)..(8): Thr or Ala
  MOD_RES (9)..(9): Tyr, Asn or His
  MOD_RES (10)..(10): Phe or Tyr
XXXXXGXXXXNPSLKS

SEQ ID NO: 1717 - protein, 17 aa, Artificial Sequence
  Description of Artificial Sequence: Synthetic peptide
LIWYDGDNKYYADSVKG

SEQ ID NO: 1718 - protein, 17 aa, Artificial Sequence
  Description of Artificial Sequence: Synthetic peptide
GISYDGSNKNYADSVKG

SEQ ID NO: 1719 - protein, 17 aa, Artificial Sequence
  Description of Artificial Sequence: Synthetic peptide
IIWYDGSNKNYADSVKG

SEQ ID NO: 1720 - protein, 17 aa, Artificial Sequence
  Description of Artificial Sequence: Synthetic peptide
LIWYDGSNKNYADSVKG

SEQ ID NO: 1721 - protein, 17 aa, Artificial Sequence
  Description of Artificial Sequence: Synthetic peptide
LIWYDGSNKDYADSVKG

SEQ ID NO: 1722 - protein, 17 aa, Artificial Sequence
  Description of Artificial Sequence: Synthetic peptide
VIWYDGSNKDYADSVKG

SEQ ID NO: 1723 - protein, 17 aa, Artificial Sequence
  Description of Artificial Sequence: Synthetic peptide
LISYDGSNKYYADSVKG

SEQ ID NO: 1724 - protein, 17 aa, Artificial Sequence
  Description of Artificial Sequence: Synthetic peptide
VISYDGSNKHYADSVKG

SEQ ID NO: 1725 - protein, 17 aa, Artificial Sequence
  Description of Artificial Sequence: Synthetic peptide
VISYDGSNKYYADSVKG

SEQ ID NO: 1726 - protein, 17 aa, Artificial Sequence
  Description of Artificial Sequence: Synthetic peptide
VIWDDGSNKYYADSVKG

SEQ ID NO: 1727 - protein, 17 aa, Artificial Sequence
  Description of Artificial Sequence: Synthetic peptide
VIWDDGSNNYYADSVKG

SEQ ID NO: 1728 - protein, 17 aa, Artificial Sequence
  Description of Artificial Sequence: Synthetic peptide
VIWYDGSNKYHADSVKG

SEQ ID NO: 1729 - protein, 17 aa, Artificial Sequence
  Description of Artificial Sequence: Synthetic peptide
VIWYDGSNKYYADSVKG

SEQ ID NO: 1730 - protein, 17 aa, Artificial Sequence
  Description of Artificial Sequence: Synthetic peptide
VIWNDGNNKYYADSVKG

SEQ ID NO: 1731 - protein, 17 aa, Artificial Sequence
  Description of Artificial Sequence: Synthetic peptide
VIWNDGSNKNYADSVKG

SEQ ID NO: 1732 - protein, 17 aa, Artificial Sequence
  Description of Artificial Sequence: Synthetic peptide
  MOD_RES (1)..(1): Leu, Gly, Ile or Val
  MOD_RES (3)..(3): Trp or Ser
  MOD_RES (4)..(4): Tyr, Asp or Asn
  MOD_RES (7)..(7): Ser or Asp
  MOD_RES (9)..(9): Lys or Asn
  MOD_RES (10)..(10): Tyr, Asn, Asp or His
  MOD_RES (11)..(11): Tyr or His
XIXXDGXNXXXADSVKG

SEQ ID NO: 1733 - protein, 17 aa, Artificial Sequence
  Description of Artificial Sequence: Synthetic peptide
WINPPSGATNYAQKFRG

SEQ ID NO: 1734 - protein, 17 aa, Artificial Sequence
  Description of Artificial Sequence: Synthetic peptide
WINPNSGGTNYAQKFRG

SEQ ID NO: 1735 - protein, 17 aa, Artificial Sequence
  Description of Artificial Sequence: Synthetic peptide
WINPNSGATNYAQKFHG

SEQ ID NO: 1736 - protein, 17 aa, Artificial Sequence
  Description of Artificial Sequence: Synthetic peptide
WINPSSGDTKYAQKFQG

SEQ ID NO: 1737 - protein, 17 aa, Artificial Sequence
  Description of Artificial Sequence: Synthetic peptide
WMNPNSGATKYAQKFQG

SEQ ID NO: 1738 - protein, 17 aa, Artificial Sequence
  Description of Artificial Sequence: Synthetic peptide
WINPNSGATKYAQKFQG

SEQ ID NO: 1739 - protein, 17 aa, Artificial Sequence
  Description of Artificial Sequence: Synthetic peptide
WINPDSGGTNYAQKFQG

SEQ ID NO: 1740 - protein, 17 aa, Artificial Sequence
  Description of Artificial Sequence: Synthetic peptide
WINPNSGGTDYAQKFQG

SEQ ID NO: 1741 - protein, 17 aa, Artificial Sequence
  Description of Artificial Sequence: Synthetic peptide
  MOD_RES (2)..(2): Ile or Met
  MOD_RES (5)..(5): Pro, Asn, Ser or Asp
  MOD_RES (8)..(8): Ala, Gly or Asp
  MOD_RES (10)..(10): Asn, Lys or Asp
  MOD_RES (16)..(16): Arg, His or Gln
WXNPXSGXTXYAQKFXG

SEQ ID NO: 1742 - protein, 16 aa, Artificial Sequence
  Description of Artificial Sequence: Synthetic peptide
EINHSENTNYNPSLKS

SEQ ID NO: 1743 - protein, 16 aa, Artificial Sequence
  Description of Artificial Sequence: Synthetic peptide
EINHSGTTNYNPSLKS

SEQ ID NO: 1744 - protein, 16 aa, Artificial Sequence
  Description of Artificial Sequence: Synthetic peptide
  MOD_RES (6)..(6): Glu or Gly
  MOD_RES (7)..(7): Asn or Thr
EINHSXXTNYNPSLKS

SEQ ID NO: 1745 - protein, 17 aa, Artificial Sequence
  Description of Artificial Sequence: Synthetic peptide
IIYPGDSDTRYSPSFQG

SEQ ID NO: 1746 - protein, 17 aa, Artificial Sequence
  Description of Artificial Sequence: Synthetic peptide
IIYPGDSETRYSPSFQG

SEQ ID NO: 1747 - protein, 17 aa, Artificial Sequence
  Description of Artificial Sequence: Synthetic peptide
  MOD_RES (8)..(8): Asp or Glu
IIYPGDSXTRYSPSFQG

SEQ ID NO: 1748 - protein, 17 aa, Artificial Sequence
  Description of Artificial Sequence: Synthetic peptide
SISSSSTYIYYADSVKG

SEQ ID NO: 1749 - protein, 17 aa, Artificial Sequence
  Description of Artificial Sequence: Synthetic peptide
SISSSSTYIYYADSLKG

SEQ ID NO: 1750 - protein, 17 aa, Artificial Sequence
  Description of Artificial Sequence: Synthetic peptide
SISSSSSYEYYVDSVKG

SEQ ID NO: 1751 - protein, 17 aa, Artificial Sequence
  Description of Artificial Sequence: Synthetic peptide
  MOD_RES (7)..(7): Thr or Ser
  MOD_RES (9)..(9): Ile or Glu
  MOD_RES (12)..(12): Ala or Val
  MOD_RES (15)..(15): Val or Leu
SISSSSXYXYYXDSXKG

SEQ ID NO: 1752 - protein, 19 aa, Artificial Sequence
  Description of Artificial Sequence: Synthetic peptide
RIKSKTDGGTTDYAAPVKG

SEQ ID NO: 1753 - protein, 19 aa, Artificial Sequence
  Description of Artificial Sequence: Synthetic peptide
RIKSKTDGGTTEYAAPVKG

SEQ ID NO: 1754 - protein, 19 aa, Artificial Sequence
  Description of Artificial Sequence: Synthetic peptide
RIIGKTDGGTTDYAAPVKG

SEQ ID NO: 1755 - protein, 19 aa, Artificial Sequence
  Description of Artificial Sequence: Synthetic peptide
  MOD_RES (3)..(3): Lys or Ile
  MOD_RES (4)..(4): Ser or Gly
  MOD_RES (12)..(12): Asp or Glu
RIXXKTDGGTTXYAAPVKG

SEQ ID NO: 1756 - protein, 17 aa, Artificial Sequence
  Description of Artificial Sequence: Synthetic peptide
GISGSSAGTYYADSVGK

SEQ ID NO: 1757 - protein, 17 aa, Artificial Sequence
  Description of Artificial Sequence: Synthetic peptide
VISDSGGSTYYADSVKG

SEQ ID NO: 1758 - protein, 17 aa, Artificial Sequence
  Description of Artificial Sequence: Synthetic peptide
VISGSGGDTYYADSVKG

SEQ ID NO: 1759 - protein, 17 aa, Artificial Sequence
  Description of Artificial Sequence: Synthetic peptide
  MOD_RES (4)..(4): Asp or Gly
  MOD_RES (8)..(8): Ser or Asp
VISXSGGXTYYADSVKG

SEQ ID NO: 1760 - protein, 18 aa, Artificial Sequence
  Description of Artificial Sequence: Synthetic peptide
RTYYRSKWYNDYAVSVKS

SEQ ID NO: 1761 - protein, 16 aa, Artificial Sequence
  Description of Artificial Sequence: Synthetic peptide
RIYISGSTNYNPSLEN

SEQ ID NO: 1762 - protein, 16 aa, Artificial Sequence
  Description of Artificial Sequence: Synthetic peptide
RIYTSGSTNYNPSLKS

SEQ ID NO: 1763 - protein, 16 aa, Artificial Sequence
  Description of Artificial Sequence: Synthetic peptide
  MOD_RES (4)..(4): Ile or Thr
  MOD_RES (15)..(15): Glu or Lys
  MOD_RES (16)..(16): Asn or Ser
RIYXSGSTNYNPSLXX

SEQ ID NO: 1764 - protein, 17 aa, Artificial Sequence
  Description of Artificial Sequence: Synthetic peptide
WMNPYSGSTGYAQNFQG

SEQ ID NO: 1765 - protein, 17 aa, Artificial Sequence
  Description of Artificial Sequence: Synthetic peptide
WMNPYSGSTGLAQRFQD

SEQ ID NO: 1766 - protein, 17 aa, Artificial Sequence
  Description of Artificial Sequence: Synthetic peptide
  MOD_RES (11)..(11): Tyr or Leu
  MOD_RES (14)..(14): Asn or Arg
  MOD_RES (17)..(17): Gly or Asp
WMNPYSGSTGXAQXFQX

SEQ ID NO: 1767 - protein, 7 aa, Artificial Sequence
  Description of Artificial Sequence: Synthetic peptide
SGVYYWN

SEQ ID NO: 1768 - protein, 7 aa, Artificial Sequence
  Description of Artificial Sequence: Synthetic peptide
SGVYYWS

SEQ ID NO: 1769 - protein, 7 aa, Artificial Sequence
  Description of Artificial Sequence: Synthetic peptide
SGGYYWN

SEQ ID NO: 1770 - protein, 7 aa, Artificial Sequence
  Description of Artificial Sequence: Synthetic peptide
SGGYYWS

SEQ ID NO: 1771 - protein, 7 aa, Artificial Sequence
  Description of Artificial Sequence: Synthetic peptide
SGDNTWS

SEQ ID NO: 1772 - protein, 7 aa, Artificial Sequence
  Description of Artificial Sequence: Synthetic peptide
SGNYTWS

SEQ ID NO: 1773 - protein, 7 aa, Artificial Sequence
  Description of Artificial Sequence: Synthetic peptide
SGDYTWT

SEQ ID NO: 1774 - protein, 7 aa, Artificial Sequence
  Description of Artificial Sequence: Synthetic peptide
SGDYTWS

SEQ ID NO: 1775 - protein, 7 aa, Artificial Sequence
  Description of Artificial Sequence: Synthetic peptide
  MOD_RES (3)..(3): Val, Gly, Asn or Asp
  MOD_RES (4)..(4): Tyr or Asn
  MOD_RES (7)..(7): Asn, Ser or Thr
SGXXTWX

SEQ ID NO: 1776 - protein, 5 aa, Artificial Sequence
  Description of Artificial Sequence: Synthetic peptide
TYYWS

SEQ ID NO: 1777 - protein, 5 aa, Artificial Sequence
  Description of Artificial Sequence: Synthetic peptide
YYYWS

SEQ ID NO: 1778 - protein, 5 aa, Artificial Sequence
  Description of Artificial Sequence: Synthetic peptide
SYYWS

SEQ ID NO: 1779 - protein, 5 aa, Artificial Sequence
  Description of Artificial Sequence: Synthetic peptide
GYYWS

SEQ ID NO: 1780 - protein, 5 aa, Artificial Sequence
  Description of Artificial Sequence: Synthetic peptide
GYYWT

SEQ ID NO: 1781 - protein, 5 aa, Artificial Sequence
  Description of Artificial Sequence: Synthetic peptide
  MOD_RES (1)..(1): Thr, Ser or Gly
  MOD_RES (5)..(5): Ser or Thr
XYYWX

SEQ ID NO: 1782 - protein, 5 aa, Artificial Sequence
  Description of Artificial Sequence: Synthetic peptide
SYGMH

SEQ ID NO: 1783 - protein, 5 aa, Artificial Sequence
  Description of Artificial Sequence: Synthetic peptide
SFGMH

SEQ ID NO: 1784 - protein, 5 aa, Artificial Sequence
  Description of Artificial Sequence: Synthetic peptide
TYGMH

SEQ ID NO: 1785 - protein, 5 aa, Artificial Sequence
  Description of Artificial Sequence: Synthetic peptide
FYGMH

SEQ ID NO: 1786 - protein, 5 aa, Artificial Sequence
  Description of Artificial Sequence: Synthetic peptide
  MOD_RES (1)..(1): Ser, Thr or Phe
  MOD_RES (2)..(2): Tyr or Phe
XXGMH

SEQ ID NO: 1787 - protein, 5 aa, Artificial Sequence
  Description of Artificial Sequence: Synthetic peptide
SYAMS

SEQ ID NO: 1788 - protein, 5 aa, Artificial Sequence
  Description of Artificial Sequence: Synthetic peptide
SYSMN

SEQ ID NO: 1789 - protein, 5 aa, Artificial Sequence
  Description of Artificial Sequence: Synthetic peptide
SYSMS

SEQ ID NO: 1790 - protein, 5 aa, Artificial Sequence
  Description of Artificial Sequence: Synthetic peptide
  MOD_RES (3)..(3): Ala or Ser
  MOD_RES (5)..(5): Ser, Asn or Met
SYXMX

SEQ ID NO: 1791 - protein, 5 aa, Artificial Sequence
  Description of Artificial Sequence: Synthetic peptide
YYYIH

SEQ ID NO: 1792 - protein, 5 aa, Artificial Sequence
  Description of Artificial Sequence: Synthetic peptide
GYYLH

SEQ ID NO: 1793 - protein, 5 aa, Artificial Sequence
  Description of Artificial Sequence: Synthetic peptide
GYYKH

SEQ ID NO: 1794 - protein, 5 aa, Artificial Sequence
  Description of Artificial Sequence: Synthetic peptide
GYYTH

SEQ ID NO: 1795 - protein, 5 aa, Artificial Sequence
  Description of Artificial Sequence: Synthetic peptide
GYYIH

SEQ ID NO: 1796 - protein, 5 aa, Artificial Sequence
  Description of Artificial Sequence: Synthetic peptide
  MOD_RES (1)..(1): Tyr or Gly
  MOD_RES (4)..(4): Ile, Leu, Lys or Thr
XYYXH

SEQ ID NO: 1797 - protein, 5 aa, Artificial Sequence
  Description of Artificial Sequence: Synthetic peptide
SYGIH

SEQ ID NO: 1798 - protein, 5 aa, Artificial Sequence
  Description of Artificial Sequence: Synthetic peptide
SYGLH

SEQ ID NO: 1799 - protein, 5 aa, Artificial Sequence
  Description of Artificial Sequence: Synthetic peptide
  MOD_RES (4)..(4): Leu or Ile
SYGXH

SEQ ID NO: 1800 - protein, 5 aa, Artificial Sequence
  Description of Artificial Sequence: Synthetic peptide
NYGMH

SEQ ID NO: 1801 - protein, 5 aa, Artificial Sequence
  Description of Artificial Sequence: Synthetic peptide
NYGMR

SEQ ID NO: 1802 - protein, 5 aa, Artificial Sequence
  Description of Artificial Sequence: Synthetic peptide
NYNMH

SEQ ID NO: 1803 - protein, 5 aa, Artificial Sequence
  Description of Artificial Sequence: Synthetic peptide
  MOD_RES (3)..(3): Gly or Asn
  MOD_RES (5)..(5): His, Arg or Met
NYXMX

SEQ ID NO: 1804 - protein, 5 aa, Artificial Sequence
  Description of Artificial Sequence: Synthetic peptide
SYWIG

SEQ ID NO: 1805 - protein, 5 aa, Artificial Sequence
  Description of Artificial Sequence: Synthetic peptide
GYWIG

SEQ ID NO: 1806 - protein, 5 aa, Artificial Sequence
  Description of Artificial Sequence: Synthetic peptide
  MOD_RES (1)..(1): Ser or Gly
XYWIG

SEQ ID NO: 1807 - protein, 5 aa, Artificial Sequence
  Description of Artificial Sequence: Synthetic peptide
GYYMH

SEQ ID NO: 1808 - protein, 5 aa, Artificial Sequence
  Description of Artificial Sequence: Synthetic peptide
GYFMH

SEQ ID NO: 1809 - protein, 5 aa, Artificial Sequence
  Description of Artificial Sequence: Synthetic peptide
  MOD_RES (3)..(3): Tyr or Phe
GYXMH

SEQ ID NO: 1810 - protein, 5 aa, Artificial Sequence
  Description of Artificial Sequence: Synthetic peptide
SYDIN

SEQ ID NO: 1811 - protein, 5 aa, Artificial Sequence
  Description of Artificial Sequence: Synthetic peptide
SHDIN

SEQ ID NO: 1812 - protein, 5 aa, Artificial Sequence
  Description of Artificial Sequence: Synthetic peptide
SYDID

SEQ ID NO: 1813 - protein, 5 aa, Artificial Sequence
  Description of Artificial Sequence: Synthetic peptide
  MOD_RES (2)..(2): Tyr or His
  MOD_RES (5)..(5): Asn or Asp
SXDIX

SEQ ID NO: 1814 - protein, 5 aa, Artificial Sequence
  Description of Artificial Sequence: Synthetic peptide
NYAMS

SEQ ID NO: 1815 - protein, 5 aa, Artificial Sequence
  Description of Artificial Sequence: Synthetic peptide
HYAMS

SEQ ID NO: 1816 - protein, 5 aa, Artificial Sequence
  Description of Artificial Sequence: Synthetic peptide
  MOD_RES (1)..(1): Asn or His
XYAMS

SEQ ID NO: 1817 - protein, 5 aa, Artificial Sequence
  Description of Artificial Sequence: Synthetic peptide
NAWMS

SEQ ID NO: 1818 - protein, 7 aa, Artificial Sequence
  Description of Artificial Sequence: Synthetic peptide
SSSYYWG

SEQ ID NO: 1819 - protein, 5 aa, Artificial Sequence
  Description of Artificial Sequence: Synthetic peptide
DYYWN

SEQ ID NO: 1820 - protein, 5 aa, Artificial Sequence
  Description of Artificial Sequence: Synthetic peptide
SYYWN

SEQ ID NO: 1821 - protein, 5 aa, Artificial Sequence
  Description of Artificial Sequence: Synthetic peptide
  MOD_RES (1)..(1): Asp or Ser
XYYWN

SEQ ID NO: 1822 - protein, 7 aa, Artificial Sequence
  Description of Artificial Sequence: Synthetic peptide
SNSATWN

SEQ ID NO: 1823 - protein, 7 aa, Artificial Sequence
  Description of Artificial Sequence: Synthetic peptide
SNSAAWN

SEQ ID NO: 1824 - protein, 7 aa, Artificial Sequence
  Description of Artificial Sequence: Synthetic peptide
  MOD_RES (5)..(5): Thr or Ala
SNSAXWN

SEQ ID NO: 1825 - protein, 5 aa, Artificial Sequence
  Description of Artificial Sequence: Synthetic peptide
SYDMH

SEQ ID NO: 1826 - protein, 5 aa, Artificial Sequence
  Description of Artificial Sequence: Synthetic peptide
TYDMH

SEQ ID NO: 1827 - protein, 5 aa, Artificial Sequence
  Description of Artificial Sequence: Synthetic peptide
  MOD_RES (1)..(1): Ser or Thr
XYDMH

SEQ ID NO: 1828 - protein, 5 aa, Artificial Sequence
  Description of Artificial Sequence: Synthetic peptide
CPSCP

SEQ ID NO: 1829 - protein, 5 aa, Artificial Sequence
  Description of Artificial Sequence: Synthetic peptide
CPPCP

SEQ ID NO: 1830 - protein, 6 aa, Artificial Sequence
  Description of Artificial Sequence: Synthetic 6xHis tag
HHHHHH

SEQ ID NO: 1831 - protein, 5 aa, Artificial Sequence
  Description of Artificial Sequence: Synthetic penta-His tag
HHHHH

SEQ ID NO: 1832 - protein, 822 aa, Mus musculus
MWGWKCLLFWAVLVTATLCTARPAPTLPEQAQPWGVPVEVESLLVHPGDLLQLRCRLRDDVQSINWLRDGVQLVESNRTRITGEEVEVRDSIPADSGLYACVTSSPSGSDTTYFSVNVSDALPSSEDDDDDDDSSSEEKETDNTKPNRRPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMLGSVIIYKMKSGTKKSDFHSQMAVHKLAKSIPLRRQVTVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSIPLDQYSPSFPDTRSSTCSSGEDSVFSHEPLPEEPCLPRHPTQLANSGLKRR

SEQ ID NO: 1833 - protein, 822 aa, Artificial Sequence
  Description of Artificial Sequence: Synthetic consensus sequence
  MOD_RES (3)..(3): Ser or Gly
  MOD_RES (36)..(36): Ala or Val
  MOD_RES (43)..(43): Phe or Leu
  MOD_RES (74)..(74): Ala or Val
  MOD_RES (89)..(89): Gln or Arg
  MOD_RES (149)..(149): Met or Arg
  MOD_RES (812)..(812): Ala or Thr
  MOD_RES (817)..(817): Gly or Ser
MWXWKCLLFWAVLVTATLCTARPAPTLPEQAQPWGXPVEVESXLVHPGDLLQLRCRLRDDVQSINWLRDGVQLXESNRTRITGEEVEVXDSIPADSGLYACVTSSPSGSDTTYFSVNVSDALPSSEDDDDDDDSSSEEKETDNTKPNRXPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMLGSVIIYKMKSGTKKSDFHSQMAVHKLAKSIPLRRQVTVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSIPLDQYSPSFPDTRSSTCSSGEDSVFSHEPLPEEPCLPRHPXQLANXGLKRR

SEQ ID NO: 1834 - protein, 1045 aa, Artificial Sequence
  Description of Artificial Sequence: Synthetic consensus sequence
  MOD_RES (3)..(3): Pro or Thr
  MOD_RES (22)..(22): Ile or Arg
  MOD_RES (23)..(23): Thr or Asn
  MOD_RES (26)..(26): Tyr or Ser
  MOD_RES (28)..(28): Asn or Lys
  MOD_RES (33)..(33): Gly or Arg
  MOD_RES (39)..(39): Val or Ala
  MOD_RES (44)..(44): Leu or Phe
  MOD_RES (62)..(62): Ser or Asp
  MOD_RES (64)..(64): Asn or Lys
  MOD_RES (65)..(65): Pro or Gln
  MOD_RES (66)..(66): Asn or Tyr
  MOD_RES (67)..(67): Phe or Val
  MOD_RES (72)..(72): Glu or Pro
  MOD_RES (86)..(86): Phe or Ser
  MOD_RES (94)..(94): Leu or Phe
  MOD_RES (102)..(102): Lys or Thr
  MOD_RES (112)..(112): His or Arg
  MOD_RES (120)..(120): Asn or Gly
  MOD_RES (122)..(122): Ser or Asn
  MOD_RES (123)..(123): Ser or Gly
  MOD_RES (125)..(125): Asn or Asp
  MOD_RES (126)..(126): Gly or Arg
  MOD_RES (139)..(139): Ser or Leu
  MOD_RES (161)..(161): Asp or Asn
  MOD_RES (163)..(163): Ile or Thr
  MOD_RES (165)..(165): Thr or Ala
  MOD_RES (166)..(167): Val or Ala
  MOD_RES (170)..(170): Lys or Gln
  MOD_RES (173)..(173): Gln or Arg
  MOD_RES (176)..(176): Ser or Arg
  MOD_RES (177)..(177): Thr or Ala
  MOD_RES (201)..(201): Ala or Thr
  MOD_RES (205)..(205): Lys or Glu
  MOD_RES (212)..(212): Asp or Ala
  MOD_RES (228)..(228): Met or Thr
  MOD_RES (264)..(264): Ala or Thr
  MOD_RES (285)..(285): Asn or Asp
  MOD_RES (286)..(286): Thr or Lys
  MOD_RES (287)..(287): His or Asn
  MOD_RES (313)..(313): Thr or Met
  MOD_RES (314)..(314): Met or Glu
  MOD_RES (317)..(317): Phe or Ile
  MOD_RES (318)..(318): Lys or Asn
  MOD_RES (321)..(321): Gln or His
  MOD_RES (324)..(324): Val or Ser
  MOD_RES (343)..(343): Gly or Phe
  MOD_RES (346)..(346): Lys or Thr
  MOD_RES (347)..(347): Lys or Gly
  MOD_RES (348)..(348): Leu or absent
  MOD_RES (349)..(349): Phe or absent
  MOD_RES (354)..(354): Ile or glu
  MOD_RES (361)..(361): His or Glu
  MOD_RES (382)..(382): Leu or Ser
  MOD_RES (386)..(386): Ala or Val
  MOD_RES (398)..(398): Glu or Gln
  MOD_RES (399)..(399): Ala or Val
  MOD_RES (408)..(409): Asn or Asp
  MOD_RES (411)..(411): Arg or Gln
  MOD_RES (424)..(424): Arg or Tyr
  MOD_RES (441)..(441): Ser or Asn
  MOD_RES (449)..(449): Leu or Phe
  MOD_RES (474)..(474): Ile or Thr
  MOD_RES (486)..(486): Lys or Glu
  MOD_RES (504)..(504): Arg or Gln
  MOD_RES (509)..(509): Ser or Pro
  MOD_RES (518)..(518): Gln or Lys
  MOD_RES (520)..(520): Gln or Arg
  MOD_RES (538)..(538): Ser or Phe
  MOD_RES (539)..(539): Val or Thr
  MOD_RES (540)..(540): Ala or Val
  MOD_RES (555)..(555): Ala or Val
  MOD_RES (581)..(581): Asn or Ser
  MOD_RES (585)..(585): Gln or Arg
  MOD_RES (598)..(598): Arg or Gln
  MOD_RES (604)..(604): Ala or Thr
  MOD_RES (614)..(614): Ala or Lys
  MOD_RES (619)..(619): Ala or Val
  MOD_RES (636)..(636): Ser or Phe
  MOD_RES (637)..(637): Ala or Pro
  MOD_RES (653)..(653): Glu or Leu
  MOD_RES (657)..(657): His or Ser
  MOD_RES (659)..(659): Asp or Gly
  MOD_RES (664)..(664): Pro or Met
  MOD_RES (665)..(665): Ser or Asn
  MOD_RES (668)..(668): Glu or Lys
  MOD_RES (672)..(672): Ala or Asp
  MOD_RES (675)..(675): Gly or Glu
  MOD_RES (679)..(679): Gln or Arg
  MOD_RES (705)..(705): Gly or Ser
  MOD_RES (710)..(710): Gly or Arg
  MOD_RES (721)..(721): Leu or Gln
  MOD_RES (722)..(722): Ala or Val
  MOD_RES (724)..(724): Arg or His
  MOD_RES (733)..(733): Ser or Val
  MOD_RES (735)..(735): Arg or His
  MOD_RES (744)..(744): Ala or Cys
  MOD_RES (754)..(754): Ala or Val
  MOD_RES (785)..(785): Ala or Val
  MOD_RES (794)..(794): His or Asn
  MOD_RES (795)..(795): Arg or Gln
  MOD_RES (802)..(802): Ala or Val
  MOD_RES (806)..(806): Leu or Phe
  MOD_RES (808)..(808): Glu or Ala
  MOD_RES (809)..(809): Ala or Lys
  MOD_RES (811)..(811): Arg or Ser
  MOD_RES (821)..(821): Cys or Tyr
  MOD_RES (834)..(834): Glu or Lys
  MOD_RES (837)..(837): Ala or Asn
  MOD_RES (838)..(838): Gly or Thr
  MOD_RES (839)..(839): Ser or Asn
  MOD_RES (841)..(841): Tyr or Ser
  MOD_RES (842)..(842): Asp or Val
  MOD_RES (865)..(865): Ile or Thr
  MOD_RES (874)..(874): Arg or Ala
  MOD_RES (881)..(881): Gly or Arg
  MOD_RES (883)..(883): Met or Arg
  MOD_RES (890)..(890): Ser or Asn
  MOD_RES (895)..(895): Gln or Leu
  MOD_RES (901)..(901): Arg or Gln
  MOD_RES (908)..(908): Gly or Glu
  MOD_RES (914)..(914): Val or Ala
  MOD_RES (934)..(934): Ala or Thr
  MOD_RES (959)..(959): Asn or Ser
  MOD_RES (965)..(965): Arg or Ser
  MOD_RES (967)..(967): Phe or Leu
  MOD_RES (969)..(969): Phe or Ala
  MOD_RES (972)..(972): Ser or Arg
  MOD_RES (974)..(974): Ser or Pro
  MOD_RES (975)..(975): Arg or Ala
  MOD_RES (977)..(977): Ser or Gly
  MOD_RES (979)..(979): Thr or Pro
  MOD_RES (980)..(980): Gln or Ala
  MOD_RES (982)..(982): Asn or Asp
  MOD_RES (989)..(989): Leu or Ser
  MOD_RES (993)..(993): Gln or Glu
  MOD_RES (1000)..(1000): Leu or Phe
  MOD_RES (1005)..(1005): Phe or Ile
  MOD_RES (1009)..(1009): Val or Ala
  MOD_RES (1015)..(1015): Ala or Thr
  MOD_RES (1018)..(1018): Gln or His
  MOD_RES (1019)..(1019): Arg or His
  MOD_RES (1026)..(1026): Trp or Gln
  MOD_RES (1033)..(1033): His or Asn
  MOD_RES (1040)..(1040): Lys or His
  MOD_RES (1041)..(1041): Arg or Ser
  MOD_RES (1042)..(1042): Val or Arg
  MOD_RES (1044)..(1044): Ser or Phe
  MOD_RES (1045)..(1045): Ser or absent
MKXGCAAGSPGNEWIFFSSDEXXTRXRXTMSNXALQRSXILSAXILLRAVTGFSGDGKAIWXKXXXXSPVNXSQLFLYDTFPKNFXWGIGTGAXQVEGSWKXDGKGPSIWDXFIHSHLKXVXXTXXSSDSYIFLEKDLXALDFIGVSFYQFSISWPRLFPXGXVXXXNAXGLXYYXXLLDALVLRNIEPIVTLYHWDLPLXLQEXYGGWKNXTIIDIFNDYATYCFQXFGDRVKYWITIHNPYLVAWHGFGTGMHAPGEKGNLXAVYTVGHNLIKAHSKVWHNYXXXFRPHQKGWLSITLGSHWIEPNRSDNXXDIXXCQXSMXSVLGWFANPIHGDGDYPEXMKXXXXAMIPXFSEAEKXEMRGTADFFAFSFGPNNFKPXNTMXKMGQNVSLNLRXXLNWIKLEYXXPXILIAENGWFTDSXIKTEDTTAIYMMKNFLXQVLQAIKXDEIRVFGYTAWSLLDGFEWQDAYTXRRGLFYVDFNSXQKERKPKSSAHYYKQIIXDNGFXLKESTPDMXGXFPCDFSWGVTESVLKPEXXXSSPQFSDPHLYVWNXTGNRLLHRVEGVRLKTRPAQCTDFVXIKKXLEMLAKMKVTHYXFALDWXSILPTGNLSXVNRQXLRYYRCVVSEGLKLGIXXMVTLYHPTHAHLGLPXPLLXAXGWLNXXTAXAFQXYAXLCFXELGDLVKLWITINEPNRLSDIYNRSXNDTYXAAHNLLIAHAXXWXLYDRQFRPXQXGAVSLSLHXDWAEPANPFXDSHWKAAERFLQFEIAWFADPLFKTGDYPAXMKEYIASKXXRGLSSSXLPRXTXXEXRLLKGTVDFXALNHFTTRFVIHXQLXXXRXXADRDIQFLQDITRLSSPSRLAVXPWGVRKLLXWIRRNYXDXDIYITAXGIDDXALEDDXIRKYYLXKYLQEXLKAYLIDKVKIKGYYAFKLXEEKSKPRFGFFTSDFKAKSSIQFYXKLISSXGXPXENXSXXCXQXXEXTDCTICXFLVXKKPLIFXGCCFXSTLXLLLSIXIFXXQKRRKFXKAKNLQXIPLKKGXXXVXX

SEQ ID NO: 1835 - protein, 212 aa, Artificial Sequence
  Description of Artificial Sequence: Synthetic polypeptide
SYELTQPHSVSVATAQMARITCGGNNIGSKAVHWYQQKPGQDPVLVIYCDSNRPSGIPERFSGSNPGNTATLTISRIEAGDEADYYCQAWDSTTVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 1836 - protein, 212 aa, Artificial Sequence
  Description of Artificial Sequence: Synthetic polypeptide
SYELTQPPSVSVSPGQTANITCSGDKLGNRYTCWYQQKSGQSPVLVIYQDSERPSGIPERFSGSNSGNTATLTISGTQAMDEADYYCQAWDSTTVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 1837 - protein, 212 aa, Artificial Sequence
  Description of Artificial Sequence: Synthetic polypeptide
SYELTQPPSVSVSPGQTANITCSGDKLGDRYVCWYQQKPGQSPVLVIYQDSKRPSGIPEQFSGSNSGNTATLTISGTQAIDEADYYCQAWDSITVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 1838 - protein, 214 aa, Artificial Sequence; identical to SEQ ID NO: 28
  Description of Artificial Sequence: Synthetic polypeptide

SEQ ID NO: 1839 - protein, 214 aa, Artificial Sequence
  Description of Artificial Sequence: Synthetic polypeptide
DIQMTQSPSSLSASVGDRVTITCRASQGIRSGLGWYQQKPGKAPKRLIYAASNLQRGVPSRFSGSGSGTEFTLTVSSLQPEDFATYSCLQHNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1840 - protein, 214 aa, Artificial Sequence
  Description of Artificial Sequence: Synthetic polypeptide
DIQMTQSPSSLSASVGDRVTITCRASQGIRSGLGWYQQKPGKAPKRLIYAASNLQRGVPSRFSGSGSGTEFTLTVSSLQPEDFATYSCLQHNTYPLTFGGGTKGEIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1841 - protein, 220 aa, Artificial Sequence
  Description of Artificial Sequence: Synthetic polypeptide
DVVMTQSPLSLPVTLGQPASISYRSSQSLVYSDGDTYLNWFQQRPGQSPRRLIYKVSNWDSGVPDRFSGSGSGTDFTLKISRVEAEDVGVYYCMQGTHWRGWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1842 - protein, 220 aa, Artificial Sequence
  Description of Artificial Sequence: Synthetic polypeptide
DIVMTQTPLSLPVIPGEPASIFCRSSQSLLNSDAGTTYLDWYLQKPGRSPQLLIYTLSFRASGVPDRFSGSGSGTDFTLKITRVEAEDVGVYYCMQRIEFPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1843 - protein, 214 aa, Artificial Sequence
  Description of Artificial Sequence: Synthetic polypeptide
DIQMTQSPSSLSASIGDRVTITCRASQSISNYLNWFQQIPGKAPRLLIYAASSLQSGVPSRFSGSGSGTDFTLTISSLQPEDFATYYCQQSSSIPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1844 - protein, 449 aa, Artificial Sequence
  Description of Artificial Sequence: Synthetic polypeptide
QAQLVESGGGVVQPGRSLRLSCAASGFTFSSYGMHWVRQAPGKGLEWVAFISYAGSNKYYADSVKGRFTISRDNSKNTLYLQMSSLRAEDTAVYYCATTVTEEDYYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1845 - protein, 449 aa, Artificial Sequence
  Description of Artificial Sequence: Synthetic polypeptide
QVQLLESGPGLVKPSETLSLTCTVSGGSVSSGDYYWSWIRQPPGKGLEWIGFIYYSGGTNYNPPLKSRVTISIDTSKNQFSLKLSSVTAADTAVYYCARYSSTWDYYYGVDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1846 - protein, 107 aa, Artificial Sequence
  Description of Artificial Sequence: Synthetic polypeptide
SYELTQPHSVSVATAQMARITCGGNNIGSKAVHWYQQKPGQDPVLVIYCDSNRPSGIPERFSGSNPGNTATLTISRIEAGDEADYYCQAWDSTTVVFGGGTKLTVLG

SEQ ID NO: 1847 - protein, 107 aa, Artificial Sequence
  Description of Artificial Sequence: Synthetic polypeptide
SYELTQPPSVSVSPGQTANITCSGDKLGNRYTCWYQQKSGQSPVLVIYQDSERPSGIPERFSGSNSGNTATLTISGTQAMDEADYYCQAWDSTTVVFGGGTKLTVLG

SEQ ID NO: 1848 - protein, 107 aa, Artificial Sequence
  Description of Artificial Sequence: Synthetic polypeptide
SYELTQPPSVSVSPGQTANITCSGDKLGDRYVCWYQQKPGQSPVLVIYQDSKRPSGIPEQFSGSNSGNTATLTISGTQAIDEADYYCQAWDSITVVFGGGTKLTVLG

SEQ ID NO: 1849 - protein, 108 aa, Artificial Sequence; identical to SEQ ID NO: 231
  Description of Artificial Sequence: Synthetic polypeptide

SEQ ID NO: 1850 - protein, 108 aa, Artificial Sequence
  Description of Artificial Sequence: Synthetic polypeptide
DIQMTQSPSSLSASVGDRVTITCRASQGIRSGLGWYQQKPGKAPKRLIYAASNLQRGVPSRFSGSGSGTEFTLTVSSLQPEDFATYSCLQHNSYPLTFGGGTKVEIKR

SEQ ID NO: 1851 - protein, 108 aa, Artificial Sequence
  Description of Artificial Sequence: Synthetic polypeptide
DIQMTQSPSSLSASVGDRVTITCRASQGIRSGLGWYQQKPGKAPKRLIYAASNLQRGVPSRFSGSGSGTEFTLTVSSLQPEDFATYSCLQHNTYPLTFGGGTKGEIRR

SEQ ID NO: 1852 - protein, 114 aa, Artificial Sequence
  Description of Artificial Sequence: Synthetic polypeptide
DVVMTQSPLSLPVTLGQPASISYRSSQSLVYSDGDTYLNWFQQRPGQSPRRLIYKVSNWDSGVPDRFSGSGSGTDFTLKISRVEAEDVGVYYCMQGTHWRGWTFGQGTKVEIKR

SEQ ID NO: 1853 - protein, 114 aa, Artificial Sequence
  Description of Artificial Sequence: Synthetic polypeptide
DIVMTQTPLSLPVIPGEPASIFCRSSQSLLNSDAGTTYLDWYLQKPGRSPQLLIYTLSFRASGVPDRFSGSGSGTDFTLKITRVEAEDVGVYYCMQRIEFPITFGQGTRLEIKR

SEQ ID NO: 1854 - protein, 108 aa, Artificial Sequence
  Description of Artificial Sequence: Synthetic polypeptide
DIQMTQSPSSLSASIGDRVTITCRASQSISNYLNWFQQIPGKAPRLLIYAASSLQSGVPSRFSGSGSGTDFTLTISSLQPEDFATYYCQQSSSIPWTFGQGTKVEIKR

SEQ ID NO: 1855 - protein, 123 aa, Artificial Sequence
  Description of Artificial Sequence: Synthetic polypeptide
QAQLVESGGGVVQPGRSLRLSCAASGFTFSSYGMHWVRQAPGKGLEWVAFISYAGSNKYYADSVKGRFTISRDNSKNTLYLQMSSLRAEDTAVYYCATTVTEEDYYYYGMDVWGQGTTVTVSS

SEQ ID NO: 1856 - protein, 123 aa, Artificial Sequence
  Description of Artificial Sequence: Synthetic polypeptide
QVQLLESGPGLVKPSETLSLTCTVSGGSVSSGDYYWSWIRQPPGKGLEWIGFIYYSGGTNYNPPLKSRVTISIDTSKNQFSLKLSSVTAADTAVYYCARYSSTWDYYYGVDVWGQGTTVTVSS

SEQ ID NO: 1857 - DNA, 321 bp, Artificial Sequence
  Description of Artificial Sequence: Synthetic polynucleotide
tcctatgagctgactcagccacactcagtgtcagtggccacagcacagatggccaggatcacctgtgggggaaacaacattggaagtaaagctgtgcactggtaccagcaaaagccaggccaggaccctgtgctggtcatctattgcgatagcaaccggccctcagggatccctgagcgattctctggctccaacccagggaacaccgccaccctaaccatcagcaggatcgaggctggggatgaggctgactattactgtcaggcgtgggacagcaccactgtggtattcggcggagggaccaagttgaccgtcctaggt

SEQ ID NO: 1858 - DNA, 261 bp, Artificial Sequence
  Description of Artificial Sequence: Synthetic polynucleotide
acctgctctggagataaattggggaatagatatacttgctggtatcagcagaagtcaggccagtcccctgtgctggtcatctatcaagatagcgagcggccctcagggatccctgagcgattctctggctccaactctgggaacacagccactctgaccatcagcgggacccaggctatggatgaggctgactattactgtcaggcgtgggacagcaccactgtggtattcggcggagggaccaagttgaccgtcctaggt

SEQ ID NO: 1859 - DNA, 321 bp, Artificial Sequence
  Description of Artificial Sequence: Synthetic polynucleotide
tcctatgagctgactcagccaccctcagtgtccgtgtccccaggacagacagccaacatcacctgctctggagataaattgggggatagatatgtttgttggtatcagcagaagccaggccagtcccctgtgctggtcatctatcaagatagcaagcggccctcagggatccctgaacaattctctggctccaactctgggaacacagccactctgaccatcagcgggacccaggctatagatgaggctgactattactgtcaggcgtgggacagcatcactgtggtattcggcggagggaccaagctgaccgtcctaggt

SEQ ID NO: 1860 - DNA, 324 bp, Artificial Sequence; identical to SEQ ID NO: 423
  Description of Artificial Sequence: Synthetic polynucleotide

SEQ ID NO: 1861 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaagtggtttaggctggtatcagcagaaaccagggaaagcccctaagcgcctgatctatgctgcatccaatttgcaaaggggggtcccatcaaggttcagcggcagtggatctgggacagaattcactctcacagtcagcagtctgcagcctgaagattttgcaacttattcctgtctccagcataatagttaccctctcactttcggcggagggaccaaggtggagatcaaacga

SEQ ID NO: 1862 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaagtggtttaggctggtatcaacagaaaccagggaaagcccctaagcgcctgatctatgctgcatccaatttgcaaaggggggtcccatcaaggttcagcggcagtggatctgggacagaattcactctcacagtcagcagtctgcagcctgaagattttgcaacttattcctgtctccaacataatacttaccctctcactttcggcggagggaccaagggggagatcagacga

SEQ ID NO: 1863 - DNA, 342 bp, Artificial Sequence
  Description of Artificial Sequence: Synthetic polynucleotide
gatgttgtgatgactcagtctccactctccctgcccgtcacccttggacagccggcctccatctcctacaggtctagtcaaagcctcgtatacagtgatggagacacctacttgaattggtttcagcagaggccaggccaatctccaaggcgcctaatttataaggtttctaactgggactctggggtcccagacagattcagcggcagtgggtcaggcactgatttcacactgaaaatcagcagggtggaggctgaggatgttggggtttattactgcatgcaaggtacacactggcggggttggacgttcggccaagggaccaaggtggaaatcaaacga

SEQ ID NO: 1864 - DNA, 342 bp, Artificial Sequence
  Description of Artificial Sequence: Synthetic polynucleotide
gatattgtaatgacccagaccccactctccctgcccgtcatccctggagagccggcctccatcttctgcaggtctagtcagagcctcttaaatagtgatgctggtaccacctatttggactggtacctgcagaagccagggcggtctccacaactcctgatctatacgctttcctttcgggcctctggagtcccagacaggttcagtggcagtgggtcaggcactgatttcacactgaaaatcactagggtggaggctgaggatgttggagtttattattgcatgcaacgtatagagttccctatcaccttcggccaagggacacgactggagattaaacga

SEQ ID NO: 1865 - DNA, 324 bp, Artificial Sequence
  Description of Artificial Sequence: Synthetic polynucleotide
gacatccagatgacccagtctccatcctccctgtctgcatctataggagacagagtcaccatcacttgccgggcaagtcagagcattagcaactatttaaattggtttcagcagatcccagggaaagcccctaggctcctgatctatgcagcttccagtttgcaaagtggggtcccatcgaggttcagtggcagtggatctgggacagatttcactctcaccatcagcagtctgcaacctgaagattttgcaacttactactgtcaacagagttccagtatcccttggacgttcggccaagggaccaaggtggaaatcaaacga

SEQ ID NO: 1866 - DNA, 369 bp, Artificial Sequence
  Description of Artificial Sequence: Synthetic polynucleotide
caggcgcagctggtggagtctgggggaggcgtggtccagcctgggaggtccctgagactctcctgtgcagcctctggattcaccttcagtagctatggcatgcactgggtccgccaggctccaggcaaggggctggagtgggtggcatttatatcatatgctggaagtaataaatactatgcagactccgtgaagggccgattcaccatctccagagacaattccaagaacacgctgtatctgcaaatgagcagcctgagagctgaggacacggctgtgtattactgtgcgactacggtgactgaggaggactactactactacggtatggacgtctggggccaagggaccacggtcaccgtctcctca

SEQ ID NO: 1867 - DNA, 369 bp, Artificial Sequence
  Description of Artificial Sequence: Synthetic polynucleotide
caggtgcagctgctggagtcgggcccaggactggtgaagccttcggagaccctgtccctcacctgcactgtctctggtggctccgtcagcagtggtgattactactggagctggatccggcagcccccagggaagggactggagtggattgggtttatttattacagtgggggcaccaactacaacccccccctcaagagtcgagtcaccatatcaatagacacgtccaagaaccagttctccctgaagctgagttctgtgaccgctgcggacacggccgtgtattactgtgcgagatatagcagcacctgggactactattacggtgtggacgtctggggccaagggaccacggtcaccgtctcctca

SEQ ID NO: 1868 - protein, 16 aa, Artificial Sequence
  Description of Artificial Sequence: Synthetic peptide
FIYYSGGTNYNPPLKS

SEQ ID NO: 1869 - protein, 17 aa, Artificial Sequence
  Description of Artificial Sequence: Synthetic peptide
FISYAGSNKYYADSVKG

SEQ ID NO: 1870 - protein, 10 aa, Artificial Sequence
  Description of Artificial Sequence: Synthetic peptide
ETGTWNFFDY

SEQ ID NO: 1871 - protein, 14 aa, Artificial Sequence
  Description of Artificial Sequence: Synthetic peptide
TVTEEDYYYYGMDV

SEQ ID NO: 1872 - protein, 11 aa, Artificial Sequence
  Description of Artificial Sequence: Synthetic peptide
RASQGIRSGLG

SEQ ID NO: 1873 - protein, 12 aa, Artificial Sequence
  Description of Artificial Sequence: Synthetic peptide
RASQSVSSIYLA

SEQ ID NO: 1874 - protein, 17 aa, Artificial Sequence
  Description of Artificial Sequence: Synthetic peptide
RSSQSLLNSDAGTTYLD

SEQ ID NO: 1875 - protein, 16 aa, Artificial Sequence
  Description of Artificial Sequence: Synthetic peptide
RSSQSLVYSDGDTYLN

SEQ ID NO: 1876 - protein, 11 aa, Artificial Sequence
  Description of Artificial Sequence: Synthetic peptide
SGDKLGDRYVC

SEQ ID NO: 1877 - protein, 11 aa, Artificial Sequence
  Description of Artificial Sequence: Synthetic peptide
SGDKLGNRYTC

SEQ ID NO: 1878 - protein, 7 aa, Artificial Sequence
  Description of Artificial Sequence: Synthetic peptide
QDSERPS

SEQ ID NO: 1879 - protein, 9 aa, Artificial Sequence
  Description of Artificial Sequence: Synthetic peptide
LQHNTYPLT

SEQ ID NO: 1880 - protein, 10 aa, Artificial Sequence
  Description of Artificial Sequence: Synthetic peptide
MQGTHWRGWT

SEQ ID NO: 1881 - protein, 9 aa, Artificial Sequence
  Description of Artificial Sequence: Synthetic peptide
QAWDSITVV

SEQ ID NO: 1882 - protein, 10 aa, Artificial Sequence
  Description of Artificial Sequence: Synthetic peptide
QVWDSSSDGV

SEQ ID NO: 1883 - DNA, 48 bp, Artificial Sequence
  Description of Artificial Sequence: Synthetic oligonucleotide
tttatttattacagtgggggcaccaactacaacccccccctcaagagt

SEQ ID NO: 1884 - DNA, 51 bp, Artificial Sequence
  Description of Artificial Sequence: Synthetic oligonucleotide
tttatatcatatgctggaagtaataaatactatgcagactccgtgaagggc

SEQ ID NO: 1885 - DNA, 30 bp, Artificial Sequence
  Description of Artificial Sequence: Synthetic oligonucleotide
gagactggaacttggaacttctttgactac

SEQ ID NO: 1886 - DNA, 42 bp, Artificial Sequence
  Description of Artificial Sequence: Synthetic oligonucleotide
acggtgactgaggaggactactactactacggtatggacgtc

SEQ ID NO: 1887 - DNA, 36 bp, Artificial Sequence
  Description of Artificial Sequence: Synthetic oligonucleotide
agggccagtcagagtgttagcagcatctacttagcc

SEQ ID NO: 1888 - DNA, 48 bp, Artificial Sequence
  Description of Artificial Sequence: Synthetic oligonucleotide
aggtctagtcaaagcctcgtatacagtgatggagacacctacttgaat

SEQ ID NO: 1889 - DNA, 33 bp, Artificial Sequence
  Description of Artificial Sequence: Synthetic oligonucleotide
cgggcaagtcagggcattagaagtggtttaggc

SEQ ID NO: 1890 - DNA, 33 bp, Artificial Sequence
  Description of Artificial Sequence: Synthetic oligonucleotide
tctggagataaattggggaatagatatacttgc

SEQ ID NO: 1891 - DNA, 33 bp, Artificial Sequence
  Description of Artificial Sequence: Synthetic oligonucleotide
tctggagataaattgggggatagatatgtttgt

SEQ ID NO: 1892 - DNA, 21 bp, Artificial Sequence
  Description of Artificial Sequence: Synthetic oligonucleotide
caagatagcgagcggccctca

SEQ ID NO: 1893 - DNA, 39 bp, Artificial Sequence; identical to SEQ ID NO: 1223
  Description of Artificial Sequence: Synthetic oligonucleotide

SEQ ID NO: 1894 - DNA, 27 bp, Artificial Sequence
  Description of Artificial Sequence: Synthetic oligonucleotide
ctccaacataatacttaccctctcact

SEQ ID NO: 1895 - DNA, 30 bp, Artificial Sequence
  Description of Artificial Sequence: Synthetic oligonucleotide
atgcaaggtacacactggcggggttggacg

SEQ ID NO: 1896 - DNA, 27 bp, Artificial Sequence
  Description of Artificial Sequence: Synthetic oligonucleotide
caggcgtgggacagcatcactgtggta

SEQ ID NO: 1897 - DNA, 30 bp, Artificial Sequence; identical to SEQ ID NO: 1411
  Description of Artificial Sequence: Synthetic oligonucleotide

SEQ ID NO: 1898 - protein, 1042 aa, Artificial Sequence
  huBeta KlothoCl-81, 523-1044)(muBetaKLOTHO 82-520)
MKPGCAAGSPGNEWIFFSTDEITTRYRNTMSNGGLQRSVILSALILLRAVTGFSGDGRAIWSKNPNFTPVNESQLFLYDTFPKNFSWGVGTGAFQVEGSWKTDGRGPSIWDRYVYSHLRGVNGTDRSTDSYIFLEKDLLALDFLGVSFYQFSISWPRLFPNGTVAAVNAQGLRYYRALLDSLVLRNIEPIVTLYHWDLPLTLQEEYGGWKNATMIDLFNDYATYCFQTFGDRVKYWITIHNPYLVAWHGFGTGMHAPGEKGNLTAVYTVGHNLIKAHSKVWHNYDKNFRPHQKGWLSITLGSHWIEPNRTDNMEDVINCQHSMSSVLGWFANPIHGDGDYPEFMKTGAMIPEFSEAEKEEVRGTADFFAFSFGPNNFRPSNTVVKMGQNVSLNLRQVLNWIKLEYDDPQILISENGWFTDSYIKTEDTTAIYMMKNFLNQVLQAIKFDEIRVFGYTAWTLLDGFEWQDAYTTRRGLFYVDFNSEQKERKPKSSAHYYKQIIQDNGFPLKESTPDMKGRFPCDFSWGVTESVLKPESVASSPQFSDPHLYVWNATGNRLLHRVEGVRLKTRPAQCTDFVNIKKQLEMLARMKVTHYRFALDWASVLPTGNLSAVNRQALRYYRCVVSEGLKLGISAMVTLYYPTHAHLGLPEPLLHADGWLNPSTAEAFQAYAGLCFQELGDLVKLWITINEPNRLSDIYNRSGNDTYGAAHNLLVAHALAWRLYDQQFRPSQRGAVSLSLHADWAEPANPYADSHWRAAERFLQFEIAWFAEPLFKTGDYPAAMREYIASKHRRGLSSSALPRLTEAERRLLKGTVDFCALNHFTTRFVMHEQLAGSRYDSDRDIQFLQDITRLSSPTRLAVIPWGVRKLLRWVRRNYGDMDIYITASGIDDQALEDDRLRKYYLGKYLQEVLKAYLIDKVRIKGYYAFKLAEEKSKPRFGFFTSDFKAKSSIQFYNKVISSRGFPFENSSSRCSQTQENTECTVCLFLVQKKPLIFLGCCFFSTLVLLLSIAIFQRQKRRKFWKAKNLQHIPLKKGKRVVS

SEQ ID NO: 1899 - protein, 1045 aa, Artificial Sequence
  huBeta KlothoCl-507)(muBetaKLOTHO 506F-1045S
MKPGCAAGSPGNEWIFFSTDEITTRYRNTMSNGGLQRSVILSALILLRAVTGFSGDGRAIWSKNPNFTPVNESQLFLYDTFPKNFFWGIGTGALQVEGSWKKDGKGPSIWDHFIHTHLKNVSSTNGSSDSYIFLEKDLSALDFIGVSFYQFSISWPRLFPDGIVTVANAKGLQYYSTLLDALVLRNIEPIVTLYHWDLPLALQEKYGGWKNDTIIDIFNDYATYCFQMFGDRVKYWITIHNPYLVAWHGYGTGMHAPGEKGNLAAVYTVGHNLIKAHSKVWHNYNTHFRPHQKGWLSITLGSHWIEPNRSENTMDIFKCQQSMVSVLGWFANPIHGDGDYPEGMRKKLFSVLPIFSEAEKHEMRGTADFFAFSFGPNNFKPLNTMAKMGQNVSLNLREALNWIKLEYNNPRILIAENGWFTDSRVKTEDTTAIYMMKNFLSQVLQAIRLDEIRVFGYTAWSLLDGFEWQDAYTIRRGLFYVDFNSKQKERKPKSSAHYYKQIIRENGFPLKESTPDMKGRFPCDFSWGVTESVLKPEFTVSSPQFTDPHLYVWNVTGNRLLYRVEGVRLKTRPSQCTDYVSIKKRVEMLAKMKVTHYQFALDWTSILPTGNLSKVNRQVLRYYRCVVSEGLKLGVFPMVTLYHPTHSHLGLPLPLLSSGGWLNMNTAKAFQDYAELCFRELGDLVKLWITINEPNRLSDMYNRTSNDTYRAAHNLMIAHAQVWHLYDRQYRPVQHGAVSLSLHCDWAEPANPFVDSHWKAAERFLQFEIAWFADPLFKTGDYPSVMKEYIASKNQRGLSSSVLPRFTAKESRLVKGTVDFYALNHFTTRFVIHKQLNTNRSVADRDVQFLQDITRLSSPSRLAVTPWGVRKLLAWIRRNYRDRDIYITANGIDDLALEDDQIRKYYLEKYVQEALKAYLIDKVKIKGYYAFKLTEEKSKPRFGFFTSDFRAKSSVQFYSKLISSSGLPAENRSPACGQPAEDTDCTICSFLVEKKPLIFFGCCFISTLAVLLSITVFHHQKRRKFQKARNLQNIPLKKGHSRVFS

SEQ ID NO: 1900 - protein, 1044 aa, Artificial Sequence
  huBeta Klotho(194-1044)(muBetaKLOTHO l-L193)
MKTGCAAGSPGNEWIFFSSDERNTRSRKTMSNRALQRSAVLSAFVLLRAVTGFSGDGKAIWDKKQYVSPVNPSQLFLYDTFPKNFSWGVGTGAFQVEGSWKTDGRGPSIWDRYVYSHLRGVNGTDRSTDSYIFLEKDLLALDFLGVSFYQFSISWPRLFPNGTVAAVNAQGLRYYRALLDSLVLRNIEPIVTLYHWDLPLALQEKYGGWKNDTIIDIFNDYATYCFQMFGDRVKYWITIHNPYLVAWHGYGTGMHAPGEKGNLAAVYTVGHNLIKAHSKVWHNYNTHFRPHQKGWLSITLGSHWIEPNRSENTMDIFKCQQSMVSVLGWFANPIHGDGDYPEGMRKKLFSVLPIFSEAEKHEMRGTADFFAFSFGPNNFKPLNTMAKMGQNVSLNLREALNWIKLEYNNPRILIAENGWFTDSRVKTEDTTAIYMMKNFLSQVLQAIRLDEIRVFGYTAWSLLDGFEWQDAYTIRRGLFYVDFNSKQKERKPKSSAHYYKQIIRENGFSLKESTPDVQGQFPCDFSWGVTESVLKPESVASSPQFSDPHLYVWNATGNRLLHRVEGVRLKTRPAQCTDFVNIKKQLEMLARMKVTHYRFALDWASVLPTGNLSAVNRQALRYYRCVVSEGLKLGISAMVTLYYPTHAHLGLPEPLLHADGWLNPSTAEAFQAYAGLCFQELGDLVKLWITINEPNRLSDIYNRSGNDTYGAAHNLLVAHALAWRLYDQQFRPSQRGAVSLSLHADWAEPANPYADSHWRAAERFLQFEIAWFAEPLFKTGDYPAAMREYIASKHRRGLSSSALPRLTEAERRLLKGTVDFCALNHFTTRFVMHEQLAGSRYDSDRDIQFLQDITRLSSPTRLAVIPWGVRKLLRWVRRNYGDMDIYITASGIDDQALEDDRLRKYYLGKYLQEVLKAYLIDKVRIKGYYAFKLAEEKSKPRFGFFTSDFKAKSSIQFYNKVISSRGFPFENSSSRCSQTQENTECTVCLFLVQKKPLIFLGCCFFSTLVLLLSIAIFQRQKRRKFWKAKNLQHIPLKKGKRVVS

SEQ ID NO: 1901 - protein, 1044 aa, Artificial Sequence
  huBeta KlothoCl-81. 303-1044)(muBetaKLOTHO 82P-302S)
MKPGCAAGSPGNEWIFFSTDEITTRYRNTMSNGGLQRSVILSALILLRAVTGFSGDGRAIWSKNPNFTPVNESQLFLYDTFPKNFSWGVGTGAFQVEGSWKTDGRGPSIWDRYVYSHLRGVNGTDRSTDSYIFLEKDLLALDFLGVSFYQFSISWPRLFPNGTVAAVNAQGLRYYRALLDSLVLRNIEPIVTLYHWDLPLTLQEEYGGWKNATMIDLFNDYATYCFQTFGDRVKYWITIHNPYLVAWHGFGTGMHAPGEKGNLTAVYTVGHNLIKAHSKVWHNYDKNFRPHQKGWLSITLGSHWIEPNRSENTMDIFKCQQSMVSVLGWFANPIHGDGDYPEGMRKKLFSVLPIFSEAEKHEMRGTADFFAFSFGPNNFKPLNTMAKMGQNVSLNLREALNWIKLEYNNPRILIAENGWFTDSRVKTEDTTAIYMMKNFLSQVLQAIRLDEIRVFGYTAWSLLDGFEWQDAYTIRRGLFYVDFNSKQKERKPKSSAHYYKQIIRENGFSLKESTPDVQGQFPCDFSWGVTESVLKPESVASSPQFSDPHLYVWNATGNRLLHRVEGVRLKTRPAQCTDFVNIKKQLEMLARMKVTHYRFALDWASVLPTGNLSAVNRQALRYYRCVVSEGLKLGISAMVTLYYPTHAHLGLPEPLLHADGWLNPSTAEAFQAYAGLCFQELGDLVKLWITINEPNRLSDIYNRSGNDTYGAAHNLLVAHALAWRLYDQQFRPSQRGAVSLSLHADWAEPANPYADSHWRAAERFLQFEIAWFAEPLFKTGDYPAAMREYIASKHRRGLSSSALPRLTEAERRLLKGTVDFCALNHFTTRFVMHEQLAGSRYDSDRDIQFLQDITRLSSPTRLAVIPWGVRKLLRWVRRNYGDMDIYITASGIDDQALEDDRLRKYYLGKYLQEVLKAYLIDKVRIKGYYAFKLAEEKSKPRFGFFTSDFKAKSSIQFYNKVISSRGFPFENSSSRCSQTQENTECTVCLFLVQKKPLIFLGCCFFSTLVLLLSIAIFQRQKRRKFWKAKNLQHIPLKKGKRVVS

SEQ ID NO: 1902 - protein, 1042 aa, Artificial Sequence
  huBeta KlothoCl-193, 419-1044)(muBetaKLOTHO Y194-416G)
MKPGCAAGSPGNEWIFFSTDEITTRYRNTMSNGGLQRSVILSALILLRAVTGFSGDGRAIWSKNPNFTPVNESQLFLYDTFPKNFFWGIGTGALQVEGSWKKDGKGPSIWDHFIHTHLKNVSSTNGSSDSYIFLEKDLSALDFIGVSFYQFSISWPRLFPDGIVTVANAKGLQYYSTLLDALVLRNIEPIVTLYHWDLPLTLQEEYGGWKNATMIDLFNDYATYCFQTFGDRVKYWITIHNPYLVAWHGFGTGMHAPGEKGNLTAVYTVGHNLIKAHSKVWHNYDKNFRPHQKGWLSITLGSHWIEPNRTDNMEDVINCQHSMSSVLGWFANPIHGDGDYPEFMKTGAMIPEFSEAEKEEVRGTADFFAFSFGPNNFRPSNTVVKMGQNVSLNLRQVLNWIKLEYDDPQILISENGWFTDSRVKTEDTTAIYMMKNFLSQVLQAIRLDEIRVFGYTAWSLLDGFEWQDAYTIRRGLFYVDFNSKQKERKPKSSAHYYKQILRENGFSLKESTPDVQGQFPCDFSWGVTESVLKPESVASSPQFSDPHLYVWNATGNRLLHRVEGVRLKTRPAQCTDFVNIKKQLEMLARMKVTHYRFALDWASVLPTGNLSAVNRQALRYYRCVVSEGLKLGISAMVTLYYPTHAHLGLPEPLLHADGWLNPSTAEAFQAYAGLCFQELGDLVKLWITINEPNRLSDIYNRSGNDTYGAAHNLLVAHALAWRLYDQQFRPSQRGAVSLSLHADWAEPANPYADSHWRAAERFLQFEIAWFAEPLFKTGDYPAAMREYIASKHRRGLSSSALPRLTEAERRLLKGTVDFCALNHFTTRFVMHEQLAGSRYDSDRDIQFLQDITRLSSPTRLAVIPWGVRKLLRWVRRNYGDMDIYITASGIDDQALEDDRLRKYYLGKYLQEVLKAYLIDKVRIKGYYAFKLAEEKSKPRFGFFTSDFKAKSSIQFYNKVISSRGFPFENSSSRCSQTQENTECTVCLFLVQKKPLIFLGCCFFSTLVLLLSIAIFQRQKRRKFWKAKNLQHIPLKKGKRVVS

SEQ ID NO: 1903 - protein, 1041 aa, Artificial Sequence
  huBeta KlothoCl-301, 509-1044)(muBetaKLOTHO S302-F506)
MKPGCAAGSPGNEWIFFSTDEITTRYRNTMSNGGLQRSVILSALILLRAVTGFSGDGRAIWSKNPNFTPVNESQLFLYDTFPKNFFWGIGTGALQVEGSWKKDGKGPSIWDHFIHTHLKNVSSTNGSSDSYIFLEKDLSALDFIGVSFYQFSISWPRLFPDGIVTVANAKGLQYYSTLLDALVLRNIEPNTLYHWDLPLALQEKYGGWKNDTIIDIFNDYATYCFQMFGDRVKYWITIHNPYLVAWHGYGTGMHAPGEKGNLAAVYTVGHNLIKAHSKVWHNYNTHFRPHQKGWLSITLGSHWIEPNRTDNMEDVINCQHSMSSVLGWFANPIHGDGDYPEFMKTGAMIPEFSEAEKEEVRGTADFFAFSFGPNNFRPSNTVVKMGQNVSLNLRQVLNWIKLEYDDPQILISENGWFTDSYIKTEDTTAIYMMKNFLNQVLQAIKFDEIRVFGYTAWTLLDGFEWQDAYTTRRGLFYVDFNSEQKERKPKSSAHYYKQIIQDNGFSLKESTPDVQGQFPCDFSWGVTESVLKPESVASSPQFSDPHLYVWNATGNRLLHRVEGVRLKTRPAQCTDFVNIKKQLEMLARMKVTHYRFALDWASVLPTGNLSAVNRQALRYYRCVVSEGLKLGISAMVTLYYPTHAHLGLPEPLLHADGWLNPSTAEAFQAYAGLCFQELGDLVKLWITINEPNRLSDIYNRSGNDTYGAAHNLLVAHALAWRLYDQQFRPSQRGAVSLSLHADWAEPANPYADSHWRAAERFLQFEIAWFAEPLFKTGDYPAAMREYIASKHRRGLSSSALPRLTEAERRLLKGTVDFCALNHFTTRFVMHEQLAGSRYDSDRDIQFLQDITRLSSPTRLAVIPWGVRKLLRWVRRNYGDMDIYITASGIDDQALEDDRLRKYYLGKYLQEVLKAYLIDKVRIKGYYAFKLAEEKSKPRFGFFTSDFKAKSSIQFYNKVISSRGFPFENSSSRCSQTQENTECTVCLFLVQKKPLIFLGCCFFSTLVLLLSIAIFQRQKRRKFWKAKNLQHIPLKKGKRVVS

SEQ ID NO: 1904 - protein, 1043 aa, Artificial Sequence
  huBeta KlothoCl-417, 522-1044)(muBetaKLOTHO G416-F519)
MKPGCAAGSPGNEWIFFSTDEITTRYRNTMSNGGLQRSVILSALILLRAVTGFSGDGRAIWSKNPNFTPVNESQLFLYDTFPKNFFWGIGTGALQVEGSWKKDGKGPSIWDHFIHTHLKNVSSTNGSSDSYIFLEKDLSALDFIGVSFYQFSISWPRLFPDGIVTVANAKGLQYYSTLLDALVLRNIEPNTLYHWDLPLALQEKYGGWKNDTIIDIFNDYATYCFQMFGDRVKYWITIHNPYLVAWHGYGTGMHAPGEKGNLAAVYTVGHNLIKAHSKVWHNYNTHFRPHQKGWLSITLGSHWIEPNRSENTMDIFKCQQSMVSVLGWFANPIHGDGDYPEGMRKKLFSVLPIFSEAEKHEMRGTADFFAFSFGPNNFKPLNTMAKMGQNVSLNLREALNWIKLEYNNPRILIAENGWFTDSYIKTEDTTAIYMMKNFLNQVLQAIKFDEIRVFGYTAWTLLDGFEWQDAYTTRRGLFYVDFNSEQKERKPKSSAHYYKQIIQDNGFPLKESTPDMKGRFPCDFSWGVTESVLKPESVASSPQFSDPHLYVWNATGNRLLHRVEGVRLKTRPAQCTDFVNIKKQLEMLARMKVTHYRFALDWASVLPTGNLSAVNRQALRYYRCVVSEGLKLGISAMVTLYYPTHAHLGLPEPLLHADGWLNPSTAEAFQAYAGLCFQELGDLVKLWITINEPNRLSDIYNRSGNDTYGAAHNLLVAHALAWRLYDQQFRPSQRGAVSLSLHADWAEPANPYADSHWRAAERFLQFEIAWFAEPLFKTGDYPAAMREYIASKHRRGLSSSALPRLTEAERRLLKGTVDFCALNHFTTRFVMHEQLAGSRYDSDRDIQFLQDITRLSSPTRLAVIPWGVRKLLRWVRRNYGDMDIYITASGIDDQALEDDRLRKYYLGKYLQEVLKAYLIDKVRIKGYYAFKLAEEKSKPRFGFFTSDFKAKSSIQFYNKVISSRGFPFENSSSRCSQTQENTECTVCLFLVQKKPLIFLGCCFFSTLVLLLSIAIFQRQKRRKFWKAKNLQHIPLKKGKRVVS

SEQ ID NO: 1905 - protein, 1043 aa, Artificial Sequence
  huBeta KlothoCl-507, 635-1044)(muBeta KLOTHO F06-G632)
MKPGCAAGSPGNEWIFFSTDEITTRYRNTMSNGGLQRSVILSALILLRAVTGFSGDGRAIWSKNPNFTPVNESQLFLYDTFPKNFFWGIGTGALQVEGSWKKDGKGPSIWDHFIHTHLKNVSSTNGSSDSYIFLEKDLSALDFIGVSFYQFSISWPRLFPDGIVTVANAKGLQYYSTLLDALVLRNIEPNTLYHWDLPLALQEKYGGWKNDTIIDIFNDYATYCFQMFGDRVKYWITIHNPYLVAWHGYGTGMHAPGEKGNLAAVYTVGHNLIKAHSKVWHNYNTHFRPHQKGWLSITLGSHWIEPNRSENTMDIFKCQQSMVSVLGWFANPIHGDGDYPEGMRKKLFSVLPIFSEAEKHEMRGTADFFAFSFGPNNFKPLNTMAKMGQNVSLNLREALNWIKLEYNNPRILIAENGWFTDSRVKTEDTTAIYMMKNFLSQVLQAIRLDEIRVFGYTAWSLLDGFEWQDAYTIRRGLFYVDFNSKQKERKPKSSAHYYKQIIRENGFPLKESTPDMKGRFPCDFSWGVTESVLKPEFTVSSPQFTDPHLYVWNVTGNRLLYRVEGVRLKTRPSQCTDYVSIKKRVEMLAKMKVTHYQFALDWTSILPTGNLSKVNRQVLRYYRCVVSEGLKLGISAMVTLYYPTHAHLGLPEPLLHADGWLNPSTAEAFQAYAGLCFQELGDLVKLWITINEPNRLSDIYNRSGNDTYGAAHNLLVAHALAWRLYDQQFRPSQRGAVSLSLHADWAEPANPYADSHWRAAERFLQFEIAWFAEPLFKTGDYPAAMREYIASKHRRGLSSSALPRLTEAERRLLKGTVDFCALNHFTTRFVMHEQLAGSRYDSDRDIQFLQDITRLSSPTRLAVIPWGVRKLLRWVRRNYGDMDIYITASGIDDQALEDDRLRKYYLGKYLQEVLKAYLIDKVRIKGYYAFKLAEEKSKPRFGFFTSDFKAKSSIQFYNKVISSRGFPFENSSSRCSQTQENTECTVCLFLVQKKPLIFLGCCFFSTLVLLLSIAIFQRQKRRKFWKAKNLQHIPLKKGKRVVS

SEQ ID NO: 1906 - protein, 1042 aa, Artificial Sequence
  huBeta KlothoCl-521, 738-1044)(muBeta KLOTHO 520P-735A)
MKPGCAAGSPGNEWIFFSTDEITTRYRNTMSNGGLQRSVILSALILLRAVTGFSGDGRAIWSKNPNFTPVNESQLFLYDTFPKNFFWGIGTGALQVEGSWKKDGKGPSIWDHFIHTHLKNVSSTNGSSDSYIFLEKDLSALDFIGVSFYQFSISWPRLFPDGIVTVANAKGLQYYSTLLDALVLRNIEPNTLYHWDLPLALQEKYGGWKNDTIIDIFNDYATYCFQMFGDRVKYWITIHNPYLVAWHGYGTGMHAPGEKGNLAAVYTVGHNLIKAHSKVWHNYNTHFRPHQKGWLSITLGSHWIEPNRSENTMDIFKCQQSMVSVLGWFANPIHGDGDYPEGMRKKLFSVLPIFSEAEKHEMRGTADFFAFSFGPNNFKPLNTMAKMGQNVSLNLREALNWIKLEYNNPRILIAENGWFTDSRVKTEDTTAIYMMKNFLSQVLQAIRLDEIRVFGYTAWSLLDGFEWQDAYTIRRGLFYVDFNSKQKERKPKSSAHYYKQIIRENGFSLKESTPDVQGQFPCDFSWGVTESVLKPEFTVSSPQFTDPHLYVWNVTGNRLLYRVEGVRLKTRPSQCTDYVSIKKRVEMLAKMKVTHYQFALDWTSILPTGNLSKVNRQVLRYYRCVVSEGLKLGVFPMVTLYHPTHSHLGLPLPLLSSGGWLNMNTAKAFQDYAELCFRELGDLVKLWITINEPNRLSDMYNRTSNDTYRAAHNLMIAHAQVWHLYDRQYRPVQHGAVSLSLHADWAEPANPYADSHWRAAERFLQFEIAWFAEPLFKTGDYPAAMREYIASKHRRGLSSSALPRLTEAERRLLKGTVDFCALNHFTTRFVMHEQLAGSRYDSDRDIQFLQDITRLSSPTRLAVIPWGVRKLLRWVRRNYGDMDIYITASGIDDQALEDDRLRKYYLGKYLQEVLKAYLIDKVRIKGYYAFKLAEEKSKPRFGFFTSDFKAKSSIQFYNKVISSRGFPFENSSSRCSQTQENTECTVCLFLVQKKPLIFLGCCFFSTLVLLLSIAIFQRQKRRKFWKAKNLQHIPLKKGKRVV

SEQ ID NO: 1907 - protein, 1043 aa, Artificial Sequence
  huBeta KlothoCl-633, 852-1044)(muBeta KLOTHO 632G-849Q)
MKPGCAAGSPGNEWIFFSTDEITTRYRNTMSNGGLQRSVILSALILLRAVTGFSGDGRAIWSKNPNFTPVNESQLFLYDTFPKNFFWGIGTGALQVEGSWKKDGKGPSIWDHFIHTHLKNVSSTNGSSDSYIFLEKDLSALDFIGVSFYQFSISWPRLFPDGIVTVANAKGLQYYSTLLDALVLRNIEPNTLYHWDLPLALQEKYGGWKNDTIIDIFNDYATYCFQMFGDRVKYWITIHNPYLVAWHGYGTGMHAPGEKGNLAAVYTVGHNLIKAHSKVWHNYNTHFRPHQKGWLSITLGSHWIEPNRSENTMDIFKCQQSMVSVLGWFANPIHGDGDYPEGMRKKLFSVLPIFSEAEKHEMRGTADFFAFSFGPNNFKPLNTMAKMGQNVSLNLREALNWIKLEYNNPRILIAENGWFTDSRVKTEDTTAIYMMKNFLSQVLQAIRLDEIRVFGYTAWSLLDGFEWQDAYTIRRGLFYVDFNSKQKERKPKSSAHYYKQIIRENGFSLKESTPDVQGQFPCDFSWGVTESVLKPESVASSPQFSDPHLYVWNATGNRLLHRVEGVRLKTRPAQCTDFVNIKKQLEMLARMKVTHYRFALDWASVLPTGNLSAVNRQALRYYRCVVSEGLKLGVFPMVTLYHPTHSHLGLPLPLLSSGGWLNMNTAKAFQDYAELCFRELGDLVKLWITINEPNRLSDMYNRTSNDTYRAAHNLMIAHAQVWHLYDRQYRPVQHGAVSLSLHCDWAEPANPFVDSHWKAAERFLQFEIAWFADPLFKTGDYPSVMKEYIASKNQRGLSSSVLPRFTAKESRLVKGTVDFYALNHFTTRFVIHKQLNTNRSVADRDVQFLQDITRLSSPTRLAVIPWGVRKLLRWVRRNYGDMDIYITASGIDDQALEDDRLRKYYLGKYLQEVLKAYLIDKVRIKGYYAFKLAEEKSKPRFGFFTSDFKAKSSIQFYNKVISSRGFPFENSSSRCSQTQENTECTVCLFLVQKKPLIFLGCCFFSTLVLLLSIAIFQRQKRRKFWKAKNLQHIPLKKGKRVVS

SEQ ID NO: 1908 - protein, 1043 aa, Artificial Sequence
  huBeta KlothoCl-736, 967-I044)(muBeta KLOTHO 735A-963S)
MKPGCAAGSPGNEWIFFSTDEITTRYRNTMSNGGLQRSVILSALILLRAVTGFSGDGRAIWSKNPNFTPVNESQLFLYDTFPKNFFWGIGTGALQVEGSWKKDGKGPSIWDHFIHTHLKNVSSTNGSSDSYIFLEKDLSALDFIGVSFYQFSISWPRLFPDGIVTVANAKGLQYYSTLLDALVLRNIEPNTLYHWDLPLALQEKYGGWKNDTIIDIFNDYATYCFQMFGDRVKYWITIHNPYLVAWHGYGTGMHAPGEKGNLAAVYTVGHNLIKAHSKVWHNYNTHFRPHQKGWLSITLGSHWIEPNRSENTMDIFKCQQSMVSVLGWFANPIHGDGDYPEGMRKKLFSVLPIFSEAEKHEMRGTADFFAFSFGPNNFKPLNTMAKMGQNVSLNLREALNWIKLEYNNPRILIAENGWFTDSRVKTEDTTAIYMMKNFLSQVLQAIRLDEIRVFGYTAWSLLDGFEWQDAYTIRRGLFYVDFNSKQKERKPKSSAHYYKQIIRENGFSLKESTPDVQGQFPCDFSWGVTESVLKPESVASSPQFSDPHLYVWNATGNRLLHRVEGVRLKTRPAQCTDFVNIKKQLEMLARMKVTHYRFALDWASVLPTGNLSAVNRQALRYYRCVVSEGLKLGISAMVTLYYPTHAHLGLPEPLLHADGWLNPSTAEAFQAYAGLCFQELGDLVKLWITINEPNRLSDIYNRSGNDTYGAAHNLLVAHALAWRLYDQQFRPSQRGAVSLSLHCDWAEPANPFVDSHWKAAERFLQFEIAWFADPLFKTGDYPSVMKEYIASKNQRGLSSSVLPRFTAKESRLVKGTVDFYALNHFTTRFVIHKQLNTNRSVADRDVQFLQDITRLSSPSRLAVTPWGVRKLLAWIRRNYRDRDIYITANGIDDLALEDDQIRKYYLEKYVQEALKAYLIDKVKIKGYYAFKLTEEKSKPRFGFFTSDFRAKSSVQFYSKLISSSGFPFENSSSRCSQTQENTECTVCLFLVQKKPLIFLGCCFFSTLVLLLSIAIFQRQKRRKFWKAKNLQHIPLKKGKRVVS

SEQ ID NO: 1909 - protein, 1367 aa, Artificial Sequence
  huBeta KlothoC82-I044)CmuBeta KLOTHO I-8IF)
MKPGCAAGSPGNEWIFFSTDEITTRYRNTMSNGGLQRSVILSALILLRAVTGFSGDGRAIWSKNPNFTPVNESQLFLYDTFPKNFSWGVGTGAFQVEGSWKTDGRGPSIWDRYVYSHLRGVNGTDRSTDSYIFLEKDLLALDFLGVSFYQFSISWPRLFPNGTVAAVNAQGLRYYRALLDSLVLRNIEPIVTLYHWDLPLALQEKYGGWKNDTIIDIFNDYATYCFQMFGDRVKYWITIHNPYLVAWHGYGTGMHAPGEKGNLAAVYTVGHNLIKAHSKVWHNYNTHFRPHQKGWLSITLKRRKFWKAKNLQHIPLKKGKRVVSMKTGCAAGSPGNEWIFFSSDERNTRSRKTMSNRALQRSAVLSAFVLLRAVTGFSGDGKAIWDKKQYVSPVNPSQLFLYDTFPKNFFWGIGTGALQVEGSWKKDGKGPSIWDHFIHTHLKNVSSTNGSSDSYIFLEKDLSALDFIGVSFYQFSISWPRLFPDGIVTVANAKGLQYYSTLLDALVLRNIEPNTLYHWDLPLALQEKYGGWKNDTIIDIFNDYATYCFQMFGDRVKYWITIHNPYLVAWHGYGTGMHAPGEKGNLAAVYTVGHNLIKAHSKVWHNYNTHFRPHQKGWLSITLGSHWIEPNRSENTMDIFKCQQSMVSVLGWFANPIHGDGDYPEGMRKKLFSVLPIFSEAEKHEMRGTADFFAFSFGPNNFKPLNTMAKMGQNVSLNLREALNWIKLEYNNPRILIAENGWFTDSRVKTEDTTAIYMMKNFLSQVLQAIRLDEIRVFGYTAWSLLDGFEWQDAYTIRRGLFYVDFNSKQKERKPKSSAHYYKQIIRENGFSLKESTPDVQGQFPCDFSWGVTESVLKPESVASSPQFSDPHLYVWNATGNRLLHRVEGVRLKTRPAQCTDFVNIKKQLEMLARMKVTHYRFALDWASVLPTGNLSAVNRQALRYYRCVVSEGLKLGISAMVTLYYPTHAHLGLPEPLLHADGWLNPSTAEAFQAYAGLCFQELGDLVKLWITINEPNRLSDIYNRSGNDTYGAAHNLLVAHALAWRLYDQQFRPSQRGAVSLSLHADWAEPANPYADSHWRAAERFLQFEIAWFAEPLFKTGDYPAAMREYIASKHRRGLSSSALPRLTEAERRLLKGTVDFCALNHFTTRFVMHEQLAGSRYDSDRDIQFLQDITRLSSPTRLAVIPWGVRKLLRWVRRNYGDMDIYITASGIDDQALEDDRLRKYYLGKYLQEVLKAYLIDKVRIKGYYAFKLAEEKSKPRFGFFTSDFKAKSSIQFYNKVISSRGFPFENSSSRCSQTQENTECTVCLFLVQKKPLIFLGCCFFSTLVLLLSIAIFQRQKRRKFWKAKNLQHIPLKKGKRVVS

SEQ ID NO: 1910 - protein, 1044 aa, Artificial Sequence
  huBeta KlothoO-81, 194-1044)(muBeta KLOTHO 82P-193L)
MKPGCAAGSPGNEWIFFSTDEITTRYRNTMSNGGLQRSVILSALILLRAVTGFSGDGRAIWSKNPNFTPVNESQLFLYDTFPKNFSWGVGTGAFQVEGSWKTDGRGPSIWDRYVYSHLRGVNGTDRSTDSYIFLEKDLLALDFLGVSFYQFSISWPRLFPNGTVAAVNAQGLRYYRALLDSLVLRNIEPIVTLYHWDLPLALQEKYGGWKNDTIIDIFNDYATYCFQMFGDRVKYWITIHNPYLVAWHGYGTGMHAPGEKGNLAAVYTVGHNLIKAHSKVWHNYNTHFRPHQKGWLSITLGSHWIEPNRSENTMDIFKCQQSMVSVLGWFANPIHGDGDYPEGMRKKLFSVLPIFSEAEKHEMRGTADFFAFSFGPNNFKPLNTMAKMGQNVSLNLREALNWIKLEYNNPRILIAENGWFTDSRVKTEDTTAIYMMKNFLSQVLQAIRLDEIRVFGYTAWSLLDGFEWQDAYTIRRGLFYVDFNSKQKERKPKSSAHYYKQIIRENGFSLKESTPDVQGQFPCDFSWGVTESVLKPESVASSPQFSDPHLYVWNATGNRLLHRVEGVRLKTRPAQCTDFVNIKKQLEMLARMKVTHYRFALDWASVLPTGNLSAVNRQALRYYRCVVSEGLKLGISAMVTLYYPTHAHLGLPEPLLHADGWLNPSTAEAFQAYAGLCFQELGDLVKLWITINEPNRLSDIYNRSGNDTYGAAHNLLVAHALAWRLYDQQFRPSQRGAVSLSLHADWAEPANPYADSHWRAAERFLQFEIAWFAEPLFKTGDYPAAMREYIASKHRRGLSSSALPRLTEAERRLLKGTVDFCALNHFTTRFVMHEQLAGSRYDSDRDIQFLQDITRLSSPTRLAVIPWGVRKLLRWVRRNYGDMDIYITASGIDDQALEDDRLRKYYLGKYLQEVLKAYLIDKVRIKGYYAFKLAEEKSKPRFGFFTSDFKAKSSIQFYNKVISSRGFPFENSSSRCSQTQENTECTVCLFLVQKKPLIFLGCCFFSTLVLLLSIAIFQRQKRRKFWKAKNLQHIPLKKGKRVVS

SEQ ID NO: 1911 - protein, 1041 aa, Artificial Sequence
  huBeta_Klotho (1-301, 509-743, 967-1044) mu BetaKLOTHO 302-506, 742-964)
MKPGCAAGSPGNEWIFFSTDEITTRYRNTMSNGGLQRSVILSALILLRAVTGFSGDGRAIWSKNPNFTPVNESQLFLYDTFPKNFFWGIGTGALQVEGSWKKDGKGPSIWDHFIHTHLKNVSSTNGSSDSYIFLEKDLSALDFIGVSFYQFSISWPRLFPDGIVTVANAKGLQYYSTLLDALVLRNIEPNTLYHWDLPLALQEKYGGWKNDTIIDIFNDYATYCFQMFGDRVKYWITIHNPYLVAWHGYGTGMHAPGEKGNLAAVYTVGHNLIKAHSKVWHNYNTHFRPHQKGWLSITLGSHWIEPNRTDNMEDVINCQHSMSSVLGWFANPIHGDGDYPEFMKTGAMIPEFSEAEKEEVRGTADFFAFSFGPNNFRPSNTVVKMGQNVSLNLRQVLNWIKLEYDDPQILISENGWFTDSYIKTEDTTAIYMMKNFLNQVLQAIKFDEIRVFGYTAWTLLDGFEWQDAYTTRRGLFYVDFNSEQKERKPKSSAHYYKQIIQDNGFSLKESTPDVQGQFPCDFSWGVTESVLKPESVASSPQFSDPHLYVWNATGNRLLHRVEGVRLKTRPAQCTDFVNIKKQLEMLARMKVTHYRFALDWASVLPTGNLSAVNRQALRYYRCVVSEGLKLGISAMVTLYYPTHAHLGLPEPLLHADGWLNPSTAEAFQAYAGLCFQELGDLVKLWITINEPNRLSDIYNRSGNDTYGAAHNLLVAHALAWRLYDQQFRPSQRGAVSLSLHCDWAEPANPFVDSHWKAAERFLQFEIAWFADPLFKTGDYPSVMKEYIASKNQRGLSSSVLPRFTAKESRLVKGTVDFYALNHFTTRFVIHKQLNTNRSVADRDVQFLQDITRLSSPSRLAVTPWGVRKLLAWIRRNYRDRDIYITANGIDDLALEDDQIRKYYLEKYVQEALKAYLIDKVKIKGYYAFKLTEEKSKPRFGFFTSDFRAKSSVQFYSKLISSSGFPFENSSSRCSQTQENTECTVCLFLVQKKPLIFLGCCFFSTLVLLLSIAIFQRQKRRKFWKAKNLQHIPLKKGKRVVS

SEQ ID NO: 1912 - protein, 108 aa, Artificial Sequence; identical to SEQ ID NO: 261
  >49C8.1 VK

SEQ ID NO: 1913 - protein, 120 aa, Artificial Sequence
  >49C8.1 VH
QVQLVQSGAEVKKPGASVKVSCKASGYTFTSYDIDWVRQATGQGLEWMGWMNPNGGNTGYAQKFQGRVTMTRDTSINTAYMELSSLRSEDTAIYYCARGKEFSRAEFDYWGQGTLVTVSS

SEQ ID NO: 1914 - protein, 108 aa, Artificial Sequence; identical to SEQ ID NO: 264
  >49H12 N83D VK

SEQ ID NO: 1915 - protein, 119 aa, Artificial Sequence
  >49H12 N83D VH
QVQLVQSGAEVKKPGASVKVSCMASGYIFTSYDINWVRQATGQGPEWMGWMNPYSGSTGYAQNFQGRVTMTRDTSINTAYMELSSLRSEDTAVYYCAKYNWNYGAFDFWGQGTMVTVSS

SEQ ID NO: 1916 - protein, 108 aa, Artificial Sequence; identical to SEQ ID NO: 263
  >49G3.3 VK

SEQ ID NO: 1917 - protein, 123 aa, Artificial Sequence; identical to SEQ ID NO: 361
  >49G3.3 VH

SEQ ID NO: 1918 - protein, 112 aa, Artificial Sequence
  >51A8.1 VL
NFILTQPHSVSESPGKTVTISCTRSSGSIASDYVQWYQQRPGSSPTTVIYEDKERSSGVPDRFSGSIDSSSNSASLTISGLKIEDEADYYCQSYDRNNHVVFGGGTKLTVLG

SEQ ID NO: 1919 - protein, 125 aa, Artificial Sequence; identical to SEQ ID NO: 363
  >51A8.1 VH

SEQ ID NO: 1920 - protein, 108 aa, Artificial Sequence; identical to SEQ ID NO: 268
  >51E5.1 VK

SEQ ID NO: 1921 - protein, 116 aa, Artificial Sequence; identical to SEQ ID NO: 366
  >51E5.1 VH

SEQ ID NO: 1922 - protein, 108 aa, Artificial Sequence; identical to SEQ ID NO: 270
  >52A8.1 VK

SEQ ID NO: 1923 - protein, 108 aa, Artificial Sequence; identical to SEQ ID NO: 270
  >52A8.1 VK

SEQ ID NO: 1924 - protein, 108 aa, Artificial Sequence; identical to SEQ ID NO: 278
  >54A1.1 N83D VK

SEQ ID NO: 1925 - protein, 119 aa, Artificial Sequence
  >54A1.1 N83D VH
QVQLVQSGAEVKKPGASVKVSCKASGYTFTSYDINWVRQATGQGLEWMGWMNPHSGNTGYAQKFQGRVTMTRDTSINTAYMELSSLRSEDTAVYYCAKYNWNYGAFDFWGQGTMVTVSS

SEQ ID NO: 1926 - protein, 108 aa, Artificial Sequence; identical to SEQ ID NO: 286
  >56E7.3 VK

SEQ ID NO: 1927 - protein, 117 aa, Artificial Sequence; identical to SEQ ID NO: 385
  >56E7.3 VH

SEQ ID NO: 1928 - protein, 113 aa, Artificial Sequence
  >56E7.3 VH
ENMTQTPLSLPVTPGEPASISCRSSQSLFDNDDGDTYLDWYLQKPGQSPQLLIYTLSYRASGVPDRFSGSGSGTDFTLKISRVEAEDVGVYYCMQRLEFPITFGQGTRLEIKR

SEQ ID NO: 1929 - protein, 129 aa, Artificial Sequence; identical to SEQ ID NO: 390
  >58C2.1 VH

SEQ ID NO: 1930 - protein, 114 aa, Artificial Sequence; identical to SEQ ID NO: 295
  >60D7.1 N30T VK

SEQ ID NO: 1931 - protein, 129 aa, Artificial Sequence
  >60D7.1 N30T VH
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVFYCARDQYFDFWSGYPFFYYYGMDVWGQGTTVTVSS

SEQ ID NO: 1932 - protein, 108 aa, Artificial Sequence; identical to SEQ ID NO: 226
  >63AI0.1 C58S VL

SEQ ID NO: 1933 - protein, 125 aa, Artificial Sequence; identical to SEQ ID NO: 322
  >63AI0.1 C58S VH

SEQ ID NO: 1934 - protein, 107 aa, Artificial Sequence
  >63AI0.3 N20R C42S VL
SYELTQPPSVSVSPGQTARITCSGDKLGNRYTSWYQQKSGQSPVLVIYQDSERPSGIPERFSGSNSGNTATLTISGTQAMDEADYYCQAWDSTTVVFGGGTKLTVLG

SEQ ID NO: 1935 - protein, 125 aa, Artificial Sequence; identical to SEQ ID NO: 322
  >63AI0.3 N20R C42S VH

SEQ ID NO: 1936 - protein, 111 aa, Artificial Sequence; identical to SEQ ID NO: 249
  >64BI0.1 VL

SEQ ID NO: 1937 - protein, 123 aa, Artificial Sequence; identical to SEQ ID NO: 347
  >64BI0.1 VH

SEQ ID NO: 1938 - protein, 108 aa, Artificial Sequence; identical to SEQ ID NO: 230
  >66G2 VK

SEQ ID NO: 1939 - protein, 123 aa, Artificial Sequence; identical to SEQ ID NO: 327
  >66G2 VH

SEQ ID NO: 1940 - protein, 107 aa, Artificial Sequence
  >67F5 VK
ENMTQSPATLSVSPGERVTLSCRASQSVSSNLAWYQQKPGQAPRLLIHGSSNRAIGIPARFSGSGSGTEFTLTISSLQSADFAVYNCQQYEIWPWTFGQGTKVEIKR

SEQ ID NO: 1941 - protein, 119 aa, Artificial Sequence; identical to SEQ ID NO: 346
  >67F5 VH

SEQ ID NO: 1942 - protein, 114 aa, Artificial Sequence; identical to SEQ ID NO: 252
  >67C10_VK

SEQ ID NO: 1943 - protein, 123 aa, Artificial Sequence; identical to SEQ ID NO: 350
  >67CI0 VH

SEQ ID NO: 1944 - protein, 111 aa, Artificial Sequence; identical to SEQ ID NO: 250
  >68C8 VL

SEQ ID NO: 1945 - protein, 123 aa, Artificial Sequence; identical to SEQ ID NO: 348
  >68C8 VH

SEQ ID NO: 1946 - protein, 108 aa, Artificial Sequence
  >49C8.1 VK.02
DIQMTQSPSSLSASVGDRVTITCQASQDINIYLNWYQQKPGKAPKLLIYDVSNLETGVPSRFSGSGSGTDFTLTISSLQPEDIATYFCQQYDNLPFTFGPGTKVDLKR

SEQ ID NO: 1947 - protein, 108 aa, Artificial Sequence
  >49C8.1 VK.03
DIQMTQSPSSLSASVGDRVTFTCQASQDINIYLNWYQQKPGKAPKLLIYDVSNLETGVPSRFSGSGSGTDFTLTISSLQPEDIATYFCQQYDNLPFTFGPGTKVDLKR

SEQ ID NO: 1948 - protein, 108 aa, Artificial Sequence
  >49C8.1 VK.04
DIQMTQSPSSLSASVGDRVTFTCQASQDINIYLNWYQQKPGKAPKLLIYDVSNLETGVPSRFSGSGSGTDFTFTISSLQPEDFATYFCQQYDNLPFTFGPGTKVDLKR

SEQ ID NO: 1949 - protein, 108 aa, Artificial Sequence
  >49C8.1 VK.05
DIQMTQSPSSLSASVGDRVTFTCQASQDINIYLNWYQQKPGKAPKLLIYDVSNLETGVPSRFSGSGSGTDFTFTISSLQPEDVATYFCQQYDNLPFTFGPGTKVDLKR

SEQ ID NO: 1950 - protein, 108 aa, Artificial Sequence
  >49C8.1 VK.06
DIQMTQSPSSLSASVGDRVTFTCQASQDINIYLNWYQQKPGKAPKLLIYDVSNLETGVPSRFSGSGSGTDFTFTISSLQPEDIATYFCQQYDNLPFTFGQGTKVDLKR

SEQ ID NO: 1951 - protein, 108 aa, Artificial Sequence
  >49C8.1 VK.07
DIQMTQSPSSLSASVGDRVTFTCQASQDINIYLNWYQQKPGKAPKLLIYDVSNLETGVPSRFSGSGSGTDFTFTISSLQPEDIATYFCQQYDNLPFTFGGGTKVDLKR

SEQ ID NO: 1952 - protein, 120 aa, Artificial Sequence
  >49C8.1 VH.08
QVQLVQSGAEVKKPGASVKVSCKASGYTFTSYDIDWVRQAPGQGLEWMGWMNPNGGNTGYAQKFQGRVTMTRDTSINTAYMELSSLRSEDTAIYYCARGKEFSRAEFDYWGQGTLVTVSS

SEQ ID NO: 1953 - protein, 120 aa, Artificial Sequence
  >49C8.1 VH.09
QVQLVQSGAEVKKPGASVKVSCKASGYTFTSYDIDWVRQATGQGLEWMGWMNPQGGNTGYAQKFQGRVTMTRDTSINTAYMELSSLRSEDTAIYYCARGKEFSRAEFDYWGQGTLVTVSS

SEQ ID NO: 1954 - protein, 120 aa, Artificial Sequence
  >49C8.1 VH.I0
QVQLVQSGAEVKKPGASVKVSCKASGYTFTSYDIDWVRQATGQGLEWMGWMNPNTGNTGYAQKFQGRVTMTRDTSINTAYMELSSLRSEDTAIYYCARGKEFSRAEFDYWGQGTLVTVSS

SEQ ID NO: 1955 - protein, 108 aa, Artificial Sequence
  >49H12 N83D VK.0l
DIQMTQSPSSLSASVGDRVTITCQASQDITKYLNWYQQKPGKAPKLLIYDTFILETGVPSRFSGSGSGTDFTLTISSLQPEDIATYYCQQYDNLPLTFGQGTRLEIKR

SEQ ID NO: 1956 - protein, 108 aa, Artificial Sequence
  >49H12 N83D VK.02
DIQMTQSPSSLSASVGDRVTITCQASQDITKYLNWYQQKPGKAPKLLIYDTFILETGVPSRFSGSGSGTDFTFTISSLQPEDFATYYCQQYDNLPLTFGQGTRLEIKR

SEQ ID NO: 1957 - protein, 108 aa, Artificial Sequence
  >49H12 N83D VK.03
DIQMTQSPSSLSASVGDRVTITCQASQDITKYLNWYQQKPGKAPKLLIYDTFILETGVPSRFSGSGSGTDFTFTISSLQPEDVATYYCQQYDNLPLTFGQGTRLEIKR

SEQ ID NO: 1958 - protein, 119 aa, Artificial Sequence
  >49H12 N83D VH.04
QVQLVQSGAEVKKPGASVKVSCKASGYIFTSYDINWVRQATGQGPEWMGWMNPYSGSTGYAQNFQGRVTMTRDTSINTAYMELSSLRSEDTAVYYCAKYNWNYGAFDFWGQGTMVTVSS

SEQ ID NO: 1959 - protein, 119 aa, Artificial Sequence
  >49H12 N83D VH.05
QVQLVQSGAEVKKPGASVKVSCMASGYTFTSYDINWVRQATGQGPEWMGWMNPYSGSTGYAQNFQGRVTMTRDTSINTAYMELSSLRSEDTAVYYCAKYNWNYGAFDFWGQGTMVTVSS

SEQ ID NO: 1960 - protein, 119 aa, Artificial Sequence
  >49H12 N83D VH.06
QVQLVQSGAEVKKPGASVKVSCMASGYIFTSYDINWVRQAPGQGPEWMGWMNPYSGSTGYAQNFQGRVTMTRDTSINTAYMELSSLRSEDTAVYYCAKYNWNYGAFDFWGQGTMVTVSS

SEQ ID NO: 1961 - protein, 119 aa, Artificial Sequence
  >49H12 N83D VH.07
QVQLVQSGAEVKKPGASVKVSCMASGYIFTSYDINWVRQATGQGPEWMGYMNPYSGSTGYAQNFQGRVTMTRDTSINTAYMELSSLRSEDTAVYYCAKYNWNYGAFDFWGQGTMVTVSS

SEQ ID NO: 1962 - protein, 119 aa, Artificial Sequence
  >49H12 N83D VH.08
QVQLVQSGAEVKKPGASVKVSCMASGYIFTSYDINWVRQATGQGPEWMGWMNPYSGSTGYAQNFQGRVTMTRDTSINTAYMELSSLRSEDTAVYYCAKYNYNYGAFDFWGQGTMVTVSS

SEQ ID NO: 1963 - protein, 108 aa, Artificial Sequence
  >49G3.3 VK.Ol
DIQMTQSPSSLSASIGDRVTITCQASQGISNYLNWYQQKPGKAPKLLIYDASNLETGVPSRFSGSGSGTDFTLTISSLQPEDIATYYCHQYDDLPLTFGGGTKVEIRR

SEQ ID NO: 1964 - protein, 108 aa, Artificial Sequence
  >49G3.3 VK.02
DIQMTQSPSSLSASIGDRVTITCQASQGISNYLNWYQQKPGKAPKLLIYDASNLETGVPSRFSGSGSGTDFTFTISSLQPEDFATYYCHQYDDLPLTFGGGTKVEIRR

SEQ ID NO: 1965 - protein, 108 aa, Artificial Sequence
  >49G3.3 VK.03
DIQMTQSPSSLSASIGDRVTITCQASQGISNYLNWYQQKPGKAPKLLIYDASNLETGVPSRFSGSGSGTDFTFTISSLQPEDVATYYCHQYDDLPLTFGGGTKVEIRR

SEQ ID NO: 1966 - protein, 108 aa, Artificial Sequence
  >49G3.3 VK.04
DIQMTQSPSSLSASIGDRVTITCQASQGISNYLNWYQQKPGKAPKLLIYDASNLETGVPSRFSGSGSGTDFTFTISSLQPEDIATYYCHQYDDLPLTFGQGTKVEIRR

SEQ ID NO: 1967 - protein, 123 aa, Artificial Sequence
  >49G3.3 VH.05
QVTLKESGPVLVKPTQTLTLTCTVSGFSLSNPRMGVSWIRQPPGKALEWLTHIFSNDEKSYSTSLKSRLTISKDTSKSQVVLSMTNMDPVDTATYYCVRVDTLNYHYYGMDVWGQGTTVTVSS

SEQ ID NO: 1968 - protein, 123 aa, Artificial Sequence
  >49G3.3 VH.06
QVTLKESGPVLVKPTETLTLTCTFSGFSLSNPRMGVSWIRQPPGKALEWLTHIFSNDEKSYSTSLKSRLTISKDTSKSQVVLSMTNMDPVDTATYYCVRVDTLNYHYYGMDVWGQGTTVTVSS

SEQ ID NO: 1969 - protein, 123 aa, Artificial Sequence
  >49G3.3 VH.07
QVTLKESGPVLVKPTETLTLTCTVSGFSLSNPRMGVSWIRQPPGKALEWLAHIFSNDEKSYSTSLKSRLTISKDTSKSQVVLSMTNMDPVDTATYYCVRVDTLNYHYYGMDVWGQGTTVTVSS

SEQ ID NO: 1970 - protein, 123 aa, Artificial Sequence
  >49G3.3 VH.08
QVTLKESGPVLVKPTETLTLTCTVSGFSLSNPRMGVSWIRQPPGKALEWLGHIFSNDEKSYSTSLKSRLTISKDTSKSQVVLSMTNMDPVDTATYYCVRVDTLNYHYYGMDVWGQGTTVTVSS

SEQ ID NO: 1971 - protein, 123 aa, Artificial Sequence
  >49G3.3 VH.09
QVTLKESGPVLVKPTETLTLTCTVSGFSLSNPRMGVSWIRQPPGKALEWLTHIFSNDEKSYSTSLKSRLTISKDTSKSQVVLSMTNMDPVDTATYYCVRVDTLNYHYYGMDVWGQGTLVTVSS

SEQ ID NO: 1972 - protein, 123 aa, Artificial Sequence
  >49G3.3 VH.I0
QVTLKESGPVLVKPTETLTLTCTVSGFSLSNPRMGVSWIRQPPGKALEWLTHIFSNDEKSYSTSLKSRLTISKDTSKSQVVLSMTNMDPVDTATYYCVRVDTLNYHYYGMDVWGQGTMVTVSS

SEQ ID NO: 1973 - protein, 112 aa, Artificial Sequence; identical to SEQ ID NO: 265
  >51A8.1 VL.Ol

SEQ ID NO: 1974 - protein, 112 aa, Artificial Sequence
  >51A8.1 VL.02
NFILTQPHSVSESPGKTVTISCTRSSGSIASDYVQWYQQRPGSSPTTVIYEDKERSSGVPDRFSGSIDSSSNSASLTISGLKAEDEADYYCQSYDRNNHVVFGGGTKLTVLG

SEQ ID NO: 1975 - protein, 125 aa, Artificial Sequence
  >51A8.1 VH.03
QVQLVESGGGVVQPGGSLRLSCAASGFTFSSYGMHWVRQAPGKGLEWVAVISYDGSNKYYADSVKGRFTISRDNSKNTLYLQMNSLRAEDTAVYYCARADGDYPYYYYYYGMDVWGQGTTVTVSS

SEQ ID NO: 1976 - protein, 125 aa, Artificial Sequence
  >51A8.1 VH.04
QVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARADGDYPYYYYYYGMDVWGQGTTVTVSS

SEQ ID NO: 1977 - protein, 125 aa, Artificial Sequence
  >51A8.l VH.05
QVQLVESGGGVVQPGRSLRLSCAASGFTFSSYGMHWVRQAPGKGLEWVAVISYDGSNKYYAESVKGRFTISRDNSKNTLYLQMNSLRAEDTAVYYCARADGDYPYYYYYYGMDVWGQGTTVTVSS

SEQ ID NO: 1978 - protein, 125 aa, Artificial Sequence
  >51A8.l VH.06
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARAEGDYPYYYYYYGMDVWGQGTTVTVSS

SEQ ID NO: 1979 - protein, 108 aa, Artificial Sequence
  >51E5.1 VK.Ol
DIQMTQSPSSLSASVGDRVTITCRASQDIRNDLGWYQQKPGKAPKRLIYAASSLQFGVPSRFSGSGSGTEFTLTISSLQPEDFATYYCLQHSSYPLTFGGGTRVEIKR

SEQ ID NO: 1980 - protein, 108 aa, Artificial Sequence
  >51E5.1 VK.02
DIQMTQSPSSLSASVGDRVTITCRASQDIRNDLGWYQQKPGKAPNLLIYAASSLQFGVPSRFSGSGSGTEFTLTISSLQPEDFATYYCLQHSSYPLTFGGGTRVEIKR

SEQ ID NO: 1981 - protein, 108 aa, Artificial Sequence
  >51E5.1 VK.03
DIQMTQSPSSLSASVGDRVTITCRASQDIRNDLGWYQQKPGKAPNSLIYAASSLQFGVPSRFSGSGSGTEFTLTISSLQPEDFATYYCLQHSSYPLTFGGGTRVEIKR

SEQ ID NO: 1982 - protein, 108 aa, Artificial Sequence
  >51E5.1 VK.04
DIQMTQSPSSLSASVGDRVTITCRASQDIRNDLGWYQQKPGKAPNRLIYAASSLQFGVPSRFSGSGSGTEFTLTISSLQPEDFATYYCLQHSSYPLTFGQGTRVEIKR

SEQ ID NO: 1983 - protein, 116 aa, Artificial Sequence
  >51E5.1 VH.05
QVQLQQWGAGLLKPSETLSLTCAVYGGSFSGYYWSWIRQPPGKGLEWIGELEHSGSINYNPSLKSRVTISVDTSKNQFSLKLTSVTAADTAVYYCARVLGSTLDYWGQGTLVTVSS

SEQ ID NO: 1984 - protein, 116 aa, Artificial Sequence
  >51E5.1 VH.06
QVQLQQWGAGLLKPSETLSLTCAVYGGSFSGYYWSWIRQPPGKGLEWIGELDTSGSINYNPSLKSRVTISVDTSKNQFSLKLTSVTAADTAVYYCARVLGSTLDYWGQGTLVTVSS

SEQ ID NO: 1985 - protein, 108 aa, Artificial Sequence
  >52A8.1 VK.Ol
DIQMTQSPSSLSASVGDRVTITCRASQTISSYLNWHQQKPGKAPKLLIYAASSLQSGVPSRFSGSGSGTDFSLTISSLQPEDFATYYCQQSYSTPLTFGGGTKVEIKR

SEQ ID NO: 1986 - protein, 108 aa, Artificial Sequence
  >52A8.1 VK.02
DIQMTQSPSFLSASVGDRVTITCRASQTISSYLNWYQQKPGKAPKLLIYAASSLQSGVPSRFSGSGSGTDFSLTISSLQPEDFATYYCQQSYSTPLTFGGGTKVEIKR

SEQ ID NO: 1987 - protein, 108 aa, Artificial Sequence
  >52A8.1 VK.03
DIQMTQSPSFLSASVGDRVTITCRASQTISSYLNWFQQKPGKAPKLLIYAASSLQSGVPSRFSGSGSGTDFSLTISSLQPEDFATYYCQQSYSTPLTFGGGTKVEIKR

SEQ ID NO: 1988 - protein, 108 aa, Artificial Sequence
  >52A8.1 VK.04
DIQMTQSPSFLSASVGDRVTITCRASQTISSYLNWHQQKPGKAPKLLIYAASSLQSGVPSRFSGSGSGTDFSLTISSLQPEDFATYYCQQSYSTPLTFGQGTKVEIKR

SEQ ID NO: 1989 - protein, 119 aa, Artificial Sequence
  >52A8.1 VH.05
QVQLVQSGAEVKKPGASVKVSCKASGYTFTGYYLHWVRQAPGQGLEWMGYINPNSAATNYAPKFQGRVTVTRDTSISTAYMELSRLRSDDTAVYYCAREGGTYNWFDPWGQGTLVTVSS

SEQ ID NO: 1990 - protein, 119 aa, Artificial Sequence
  >52A8.1 VH.06
QVQLVQSGAEVKKPGASVKVSCKASGYTFTGYYLHWVRQAPGQGLEWMGWINPNSAATNYAPKFQGRVTVTRDTSISTAYMELSSLRSDDTAVYYCAREGGTYNWFDPWGQGTLVTVSS

SEQ ID NO: 1991 - protein, 119 aa, Artificial Sequence
  >52A8.1 VH.07
QVQLVQSGAEVKKPGASVKVSCKASGYTFTGYYLHWVRQAPGQGLEWMGWINPNSAATNYAPKFQGRVTVTRDTSISTAYMELSRLRSDDTAVYYCAREGGTYNYFDPWGQGTLVTVSS

SEQ ID NO: 1992 - protein, 108 aa, Artificial Sequence
  >54A1.1 N83D VK.Ol
DIQMTQSPSSLSASVGDRVTITCQASQDISIYLNWYQLKPGKAPKLLIYDVSNLETGVPSRFSGGGSGTDFTFTISSLQPEDIATYYCQQYDNLPLTFGPGTKVDIKR

SEQ ID NO: 1993 - protein, 108 aa, Artificial Sequence
  >54A1.1 N83D VK.02
DIQMAQSPSSLSASVGDRVTITCQASQDISIYLNWYQQKPGKAPKLLIYDVSNLETGVPSRFSGGGSGTDFTFTISSLQPEDIATYYCQQYDNLPLTFGPGTKVDIKR

SEQ ID NO: 1994 - protein, 108 aa, Artificial Sequence
  >54A1.1 N83D VK.03
DIQMAQSPSSLSASVGDRVTITCQASQDISIYLNWYQLKPGKAPKLLIYDVSNLETGVPSRFSGSGSGTDFTFTISSLQPEDIATYYCQQYDNLPLTFGPGTKVDIKR

SEQ ID NO: 1995 - protein, 108 aa, Artificial Sequence
  >54A1.1 N83D VK.04
DIQMAQSPSSLSASVGDRVTITCQASQDISIYLNWYQLKPGKAPKLLIYDVSNLETGVPSRFSGGGSGTDFTLTISSLQPEDIATYYCQQYDNLPLTFGPGTKVDIKR

SEQ ID NO: 1996 - protein, 108 aa, Artificial Sequence
  >54A1.1 N83D VK.05
DIQMAQSPSSLSASVGDRVTITCQASQDISIYLNWYQLKPGKAPKLLIYDVSNLETGVPSRFSGGGSGTDFTFTISSLQPEDFATYYCQQYDNLPLTFGPGTKVDIKR

SEQ ID NO: 1997 - protein, 108 aa, Artificial Sequence
  >54A1.1 N83D VK.06
DIQMAQSPSSLSASVGDRVTITCQASQDISIYLNWYQLKPGKAPKLLIYDVSNLETGVPSRFSGGGSGTDFTFTISSLQPEDVATYYCQQYDNLPLTFGPGTKVDIKR

SEQ ID NO: 1998 - protein, 108 aa, Artificial Sequence
  >54A1.1 N83D VK.07
DIQMAQSPSSLSASVGDRVTITCQASQDISIYLNWYQLKPGKAPKLLIYDVSNLETGVPSRFSGGGSGTDFTFTISSLQPEDIATYYCQQYDNLPLTFGGGTKVDIKR

SEQ ID NO: 1999 - protein, 108 aa, Artificial Sequence
  >54A1.1 N83D VK.08
DIQMAQSPSSLSASVGDRVTITCQASQDISIYLNWYQLKPGKAPKLLIYDVSNLETGVPSRFSGGGSGTDFTFTISSLQPEDIATYYCQQYDNLPLTFGQGTKVDIKR

SEQ ID NO: 2000 - protein, 119 aa, Artificial Sequence
  >54A1.1 N83D VH.09
QVQLVQSGAEVKKPGASVKVSCKASGYTFTSYDINWVRQAPGQGLEWMGWMNPHSGNTGYAQKFQGRVTMTRDTSINTAYMELSSLRSEDTAVYYCAKYNWNYGAFDFWGQGTMVTVSS

SEQ ID NO: 2001 - protein, 119 aa, Artificial Sequence
  >54A1.1 N83D VH.I0
QVQLVQSGAEVKKPGASVKVSCKASGYTFTSYDINWVRQATGQGLEWMGYMNPHSGNTGYAQKFQGRVTMTRDTSINTAYMELSSLRSEDTAVYYCAKYNWNYGAFDFWGQGTMVTVSS

SEQ ID NO: 2002 - protein, 119 aa, Artificial Sequence
  >54A1.1 N83D VH.ll
QVQLVQSGAEVKKPGASVKVSCKASGYTFTSYDINWVRQATGQGLEWMGWMNPHSGNTGYAQKFQGRVTMTRDTSINTAYMELSSLRSEDTAVYYCAKYNYNYGAFDFWGQGTMVTVSS

SEQ ID NO: 2003 - protein, 113 aa, Artificial Sequence
  >58C2.1 VK.Ol
ENMTQTPLSLPVTPGEPASISCRSSQSLFDNDEGDTYLDWYLQKPGQSPQLLIYTLSYRASGVPDRFSGSGSGTDFTLKISRVEAEDVGVYYCMQRLEFPITFGQGTRLEIKR

SEQ ID NO: 2004 - protein, 129 aa, Artificial Sequence
  >58C2.1 VH.02
QVQLVESGGGVVQPGGSLRLSCAASGFTFSNYGMHWVRQAPGKGLEWVAVIWNDGNNKYYADSVKGRFTISRDNSKNTLYLQMNSLRAEDTAVYYCARDQNYDFWNGYPYYFYYGMDVWGQGTTVTVSS

SEQ ID NO: 2005 - protein, 129 aa, Artificial Sequence
  >58C2.1 VH.03
QVQLVESGGGVVQPGRSLRLSCAASGFTFSNYGMHWVRQAPGKGLEWVAVIWNEGNNKYYADSVKGRFTISRDNSKNTLYLQMNSLRAEDTAVYYCARDQNYDFWNGYPYYFYYGMDVWGQGTTVTVSS

SEQ ID NO: 2006 - protein, 129 aa, Artificial Sequence
  >58C2.1 VH.04
QVQLVESGGGVVQPGRSLRLSCAASGFTFSNYGMHWVRQAPGKGLEWVAVIWNDGNNKYYAESVKGRFTISRDNSKNTLYLQMNSLRAEDTAVYYCARDQNYDFWNGYPYYFYYGMDVWGQGTTVTVSS

SEQ ID NO: 2007 - protein, 129 aa, Artificial Sequence
  >58C2.1 VH.05
QVQLVESGGGVVQPGRSLRLSCAASGFTFSNYGMHWVRQAPGKGLEWVAVIWNDGNNKYYADSVKGRFTISRDNSKNTLYLQMNSLRAEDTAVYYCARDQNYDFWQGYPYYFYYGMDVWGQGTTVTVSS

SEQ ID NO: 2008 - protein, 108 aa, Artificial Sequence
  >56E7.3 VK.Ol
DLQMTQSPSSLSASVGDRVTITCQASQDIKKFLNWYQQKPGKAPKLLIYDASNLETGVPSRFSGSGSGTDFTFTISSLQPEDIATYYCQQYAILPFTFGPGTTVDIKR

SEQ ID NO: 2009 - protein, 108 aa, Artificial Sequence
  >56E7.3 VK.02
DLQMTQSPSSLSASVGDRVTITCQASQDIKKFLNWYQQKPGKAPNLLIYDASNLETGVPSRFSGSGSGTDFTLTISSLQPEDIATYYCQQYAILPFTFGPGTTVDIKR

SEQ ID NO: 2010 - protein, 108 aa, Artificial Sequence
  >56E7.3 VK.03
DLQMTQSPSSLSASVGDRVTITCQASQDIKKFLNWYQQKPGKAPNLLIYDASNLETGVPSRFSGSGSGTDFTFTISSLQPEDFATYYCQQYAILPFTFGPGTTVDIKR

SEQ ID NO: 2011 - protein, 108 aa, Artificial Sequence
  >56E7.3 VK.04
DLQMTQSPSSLSASVGDRVTITCQASQDIKKFLNWYQQKPGKAPNLLIYDASNLETGVPSRFSGSGSGTDFTFTISSLQPEDIATYYCQQYAILPFTFGGGTTVDIKR

SEQ ID NO: 2012 - protein, 108 aa, Artificial Sequence
  >56E7.3 VK.05
DLQMTQSPSSLSASVGDRVTITCQASQDIKKFLNWYQQKPGKAPNLLIYDASNLETGVPSRFSGSGSGTDFTFTISSLQPEDIATYYCQQYAILPFTFGQGTTVDIKR

SEQ ID NO: 2013 - protein, 108 aa, Artificial Sequence
  >56E7.3 VK.06
DLQMTQSPSSLSASVGDRVTITCQASQDIKKFLNWYQQKPGKAPNLLIYDASNLETGVPSRFSGSGSGTDFTFTISSLQPEDIATYYCQQYAILPFTFGPGTKVDIKR

SEQ ID NO: 2014 - protein, 108 aa, Artificial Sequence
  >56E7.3 VK.07
DLQMTQSPSSLSASVGDRVTITCQASQDIKKFLNWYQQKPGKAPNLLIYDASNLETGVPSRFSGSGSGTDFTFTISSLQPEDIATYYCQQYAILPFTFGPGTRVDIKR

SEQ ID NO: 2015 - protein, 117 aa, Artificial Sequence
  >56E7.3 VH.08
EVQLVQSGPEVKKPGESLKISCKGSGYSFTSYWIGWVRQMPGKGLEWMGIIYPGDSDTRYSPSFQGQVTISADTSISTAYLQWSRLKASDTAVYYCARAQLGIFDYWGQGTLVTVSS

SEQ ID NO: 2016 - protein, 117 aa, Artificial Sequence
  >56E7.3 VH.09
EVQLVQSGPEVKKPGESLKISCKGSGYSLTSYWIGWVRQMPGKGLEWMGIIYPGESDTRYSPSFQGQVTISADTSISTAYLQWSRLKASDTAVYYCARAQLGIFDYWGQGTLVTVSS

SEQ ID NO: 2017 - protein, 117 aa, Artificial Sequence
  >56E7.3 VH.I0
EVQLVQSGPEVKKPGESLKISCKGSGYSLTSYWIGWVRQMPGKGLEWMGIIYPGDSDTRYSPSFQGQVTISADKSISTAYLQWSRLKASDTAVYYCARAQLGIFDYWGQGTLVTVSS

SEQ ID NO: 2018 - protein, 117 aa, Artificial Sequence
  >56E7.3 VH.ll
EVQLVQSGPEVKKPGESLKISCKGSGYSLTSYWIGWVRQMPGKGLEWMGIIYPGDSDTRYSPSFQGQVTISADTSISTAYLQWSSLKASDTAVYYCARAQLGIFDYWGQGTLVTVSS

SEQ ID NO: 2019 - protein, 114 aa, Artificial Sequence
  >60D7.1 N30T VK.Ol
DIVLTQTPLSLPVTPGEPASISCRSSQSLLESDDGDTYLDWYLQKPGQSPQLLIYTLSYRASGVPDRFSGSGSGTDFTLKISRVEAEDVGVYYCMQRIEFPLTFGGGTKVEIKR

SEQ ID NO: 2020 - protein, 114 aa, Artificial Sequence
  >60D7.1 N30T VK.02
DIVLTQTPLSLPVTPGEPASISCRSSQSLLDSDEGDTYLDWYLQKPGQSPQLLIYTLSYRASGVPDRFSGSGSGTDFTLKISRVEAEDVGVYYCMQRIEFPLTFGGGTKVEIKR

SEQ ID NO: 2021 - protein, 114 aa, Artificial Sequence; identical to SEQ ID NO: 295
  >60D7.L N30T VK

SEQ ID NO: 2022 - protein, 129 aa, Artificial Sequence
  >60D7.l N30T VH.03
QVQLVESGGGVVQPGGSLRLSCAASGFTFSSYGMHWVRQAPGKGLEWVAVIWYDGSNKYYADSVKGRFTISRDNSKNTLYLQMNSLRAEDTAVFYCARDQYFDFWSGYPFFYYYGMDVWGQGTTVTVSS

SEQ ID NO: 2023 - protein, 129 aa, Artificial Sequence
  >60D7.l N30T VH.04
QVQLVESGGGVVQPGRSLRLSCAASGFTFSSYGMHWVRQAPGKGLEWVAVIWYEGSNKYYADSVKGRFTISRDNSKNTLYLQMNSLRAEDTAVFYCARDQYFDFWSGYPFFYYYGMDVWGQGTTVTVSS

SEQ ID NO: 2024 - protein, 129 aa, Artificial Sequence
  >60D7.l N30T VH.05
QVQLVESGGGVVQPGRSLRLSCAASGFTFSSYGMHWVRQAPGKGLEWVAVIWYDGSNKYYAESVKGRFTISRDNSKNTLYLQMNSLRAEDTAVFYCARDQYFDFWSGYPFFYYYGMDVWGQGTTVTVSS

SEQ ID NO: 2025 - protein, 129 aa, Artificial Sequence
  >60D7.l N30T VH.06
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVFYCARDQYFDFYSGYPFFYYYGMDVWGQGTTVTVSS

SEQ ID NO: 2026 - protein, 108 aa, Artificial Sequence
  >63AI0.1 C58S VL.Ol
SYELTQPLSVSVATAQMARITCGGNNIGSKAVHWYQQKPGQDPVLVIYSDSNRPSGIPERFSGSNPGNTATLTISRIEAGDEADYYCQVWDSSSDGVFGGGTKLTVLG

SEQ ID NO: 2027 - protein, 108 aa, Artificial Sequence
  >63AI0.1 C58S VL.02
SYELTQPPSVSVATAQMARITCGGNNIGSKAVHWYQQKPGQDPVLVIYSDSNRPSGIPERFSGSNPGNTATLTISRIEAGDEADYYCQVWDSSSDGVFGGGTKLTVLG

SEQ ID NO: 2028 - protein, 108 aa, Artificial Sequence
  >63AI0.1 C58S VL.03
SYELTQPHSVSVALAQMARITCGGNNIGSKAVHWYQQKPGQDPVLVIYSDSNRPSGIPERFSGSNPGNTATLTISRIEAGDEADYYCQVWDSSSDGVFGGGTKLTVLG

SEQ ID NO: 2029 - protein, 108 aa, Artificial Sequence
  >63AI0.1 C58S VL.04
SYELTQPHSVSVAPAQMARITCGGNNIGSKAVHWYQQKPGQDPVLVIYSDSNRPSGIPERFSGSNPGNTATLTISRIEAGDEADYYCQVWDSSSDGVFGGGTKLTVLG

SEQ ID NO: 2030 - protein, 108 aa, Artificial Sequence
  >63AI0.1 C58S VL.05
SYELTQPHSVSVATGQMARITCGGNNIGSKAVHWYQQKPGQDPVLVIYSDSNRPSGIPERFSGSNPGNTATLTISRIEAGDEADYYCQVWDSSSDGVFGGGTKLTVLG

SEQ ID NO: 2031 - protein, 108 aa, Artificial Sequence
  >63AI0.1 C58S VL.06
SYELTQPHSVSVATAQTARITCGGNNIGSKAVHWYQQKPGQDPVLVIYSDSNRPSGIPERFSGSNPGNTATLTISRIEAGDEADYYCQVWDSSSDGVFGGGTKLTVLG

SEQ ID NO: 2032 - protein, 108 aa, Artificial Sequence
  >63AI0.1 C58S VL.07
SYELTQPHSVSVATAQMARITCGGNNIGSKAVHWYQQKPGQAPVLVIYSDSNRPSGIPERFSGSNPGNTATLTISRIEAGDEADYYCQVWDSSSDGVFGGGTKLTVLG

SEQ ID NO: 2033 - protein, 108 aa, Artificial Sequence
  >63AI0.1 C58S VL.08
SYELTQPHSVSVATAQMARITCGGNNIGSKAVHWYQQKPGQSPVLVIYSDSNRPSGIPERFSGSNPGNTATLTISRIEAGDEADYYCQVWDSSSDGVFGGGTKLTVLG

SEQ ID NO: 2034 - protein, 108 aa, Artificial Sequence
  >63AI0.1 C58S VL.09
SYELTQPHSVSVATAQMARITCGGNNIGSKAVHWYQQKPGQFPVLVIYSDSNRPSGIPERFSGSNPGNTATLTISRIEAGDEADYYCQVWDSSSDGVFGGGTKLTVLG

SEQ ID NO: 2035 - protein, 108 aa, Artificial Sequence
  >63AI0.1 C58S VL.I0
SYELTQPHSVSVATAQMARITCGGNNIGSKAVHWYQQKPGQDPVLVIYSESNRPSGIPERFSGSNPGNTATLTISRIEAGDEADYYCQVWDSSSDGVFGGGTKLTVLG

SEQ ID NO: 2036 - protein, 108 aa, Artificial Sequence
  >63AI0.1 C58S VL.l l
SYELTQPHSVSVATAQMARITCGGNNIGSKAVHWYQQKPGQDPVLVIYSDSNRPSGIPERFSGSNSGNTATLTISRIEAGDEADYYCQVWDSSSDGVFGGGTKLTVLG

SEQ ID NO: 2037 - protein, 108 aa, Artificial Sequence
  >63AI0.1 C58S VL.12
SYELTQPHSVSVATAQMARITCGGNNIGSKAVHWYQQKPGQDPVLVIYSDSNRPSGIPERFSGSNPGNTATLTISRIQAGDEADYYCQVWDSSSDGVFGGGTKLTVLG

SEQ ID NO: 2038 - protein, 108 aa, Artificial Sequence
  >63AI0.1 C58S VL.13
SYELTQPHSVSVATAQMARITCGGNNIGSKAVHWYQQKPGQDPVLVIYSDSNRPSGIPERFSGSNPGNTATLTISRIEAGDEADYYCQVWESSSDGVFGGGTKLTVLG

SEQ ID NO: 2039 - protein, 108 aa, Artificial Sequence
  >63AI0.1 C58S VL.14
SYELTQPHSVSVATAQMARITCGGNNIGSKAVHWYQQKPGQDPVLVIYSDSNRPSGIPERFSGSNPGNTATLTISRIEAGDEADYYCQVWDSSSEGVFGGGTKLTVLG

SEQ ID NO: 2040 - protein, 125 aa, Artificial Sequence
  >63AI0.1 C58S VH.15
EVQLVESGGGLVKPGGSLRLSCAVSGITFSNAWMSWVRQAPGKGLEWVGRIKSKTDGGTTDYAAPVKGRFTVSRDGSKNTLYLQMNSLKTEDTAVYYCTTDSSGSYYVEDYFDYWGQGTLVTVSS

SEQ ID NO: 2041 - protein, 125 aa, Artificial Sequence
  >63AI0.1 C58S VH.16
EVQLVESGGDLVQPGGSLRLSCAVSGITFSNAWMSWVRQAPGKGLEWVGRIKSKTDGGTTDYAAPVKGRFTVSRDGSKNTLYLQMNSLKTEDTAVYYCTTDSSGSYYVEDYFDYWGQGTLVTVSS

SEQ ID NO: 2042 - protein, 125 aa, Artificial Sequence
  >63AI0.1 C58S VH.17
EVQLVESGGDLVKPGGSLRLSCAVSGFTFSNAWMSWVRQAPGKGLEWVGRIKSKTDGGTTDYAAPVKGRFTVSRDGSKNTLYLQMNSLKTEDTAVYYCTTDSSGSYYVEDYFDYWGQGTLVTVSS

SEQ ID NO: 2043 - protein, 125 aa, Artificial Sequence
  >63AI0.1 C58S VH.18
EVQLVESGGDLVKPGGSLRLSCAVSGITFSNAWMSWVRQAPGKGLEWVSRIKSKTDGGTTDYAAPVKGRFTVSRDGSKNTLYLQMNSLKTEDTAVYYCTTDSSGSYYVEDYFDYWGQGTLVTVSS

SEQ ID NO: 2044 - protein, 125 aa, Artificial Sequence
  >63AI0.1 C58S VH.19
EVQLVESGGDLVKPGGSLRLSCAVSGITFSNAWMSWVRQAPGKGLEWVGRIKSKTEGGTTDYAAPVKGRFTVSRDGSKNTLYLQMNSLKTEDTAVYYCTTDSSGSYYVEDYFDYWGQGTLVTVSS

SEQ ID NO: 2045 - protein, 125 aa, Artificial Sequence
  >63AI0.1 C58S VH.20
EVQLVESGGDLVKPGGSLRLSCAVSGITFSNAWMSWVRQAPGKGLEWVGRIKSKTDGGTTDYAAPVKGRFTVSRDDSKNTLYLQMNSLKTEDTAVYYCTTDSSGSYYVEDYFDYWGQGTLVTVSS

SEQ ID NO: 2046 - protein, 125 aa, Artificial Sequence
  >63AI0.1 C58S VH.21
EVQLVESGGDLVKPGGSLRLSCAVSGITFSNAWMSWVRQAPGKGLEWVGRIKSKTDGGTTDYAAPVKGRFTVSRDNSKNTLYLQMNSLKTEDTAVYYCTTDSSGSYYVEDYFDYWGQGTLVTVSS

SEQ ID NO: 2047 - protein, 125 aa, Artificial Sequence
  >63AI0.1 C58S VH.22
EVQLVESGGDLVKPGGSLRLSCAVSGITFSNAWMSWVRQAPGKGLEWVGRIKSKTDGGTTDYAAPVKGRFTVSRDGSKNTLYLQMNSLKAEDTAVYYCTTDSSGSYYVEDYFDYWGQGTLVTVSS

SEQ ID NO: 2048 - protein, 125 aa, Artificial Sequence
  >63AI0.1 C58S VH.23
EVQLVESGGDLVKPGGSLRLSCAVSGITFSNAWMSWVRQAPGKGLEWVGRIKSKTDGGTTDYAAPVKGRFTVSRDGSKNTLYLQMNSLKTEDTAVYYCATDSSGSYYVEDYFDYWGQGTLVTVSS

SEQ ID NO: 2049 - protein, 125 aa, Artificial Sequence
  >63AI0.1 C58S VH.24
EVQLVESGGDLVKPGGSLRLSCAVSGITFSNAWMSWVRQAPGKGLEWVGRIKSKTDGGTTDYAAPVKGRFTVSRDGSKNTLYLQMNSLKTEDTAVYYCTRDSSGSYYVEDYFDYWGQGTLVTVSS

SEQ ID NO: 2050 - protein, 125 aa, Artificial Sequence
  >63AI0.1 C58S VH.25
EVQLVESGGDLVKPGGSLRLSCAVSGITFSNAWMSWVRQAPGKGLEWVGRIKSKTDGGTTDYAAPVKGRFTVSRDGSKNTLYLQMNSLKTEDTAVYYCTTESSGSYYVEDYFDYWGQGTLVTVSS

SEQ ID NO: 2051 - protein, 108 aa, Artificial Sequence
  >63AI0.1 C58S VL.26
SYELTQPHSVSVATAQMARITCGGNNIGSKAVHWYQQKPGQDPVLVIYSDSNRPSGIPERFSGSNPGNTATLTISRIEAGDEADYYCQVYDSSSDGVFGGGTKLTVLG

SEQ ID NO: 2052 - protein, 107 aa, Artificial Sequence
  >63AI0.3 N20R C42S VL.Ol
SYELTQPPSVSVSPGQTARITCSGDKLGNRYTSWYQQKPGQSPVLVIYQDSERPSGIPERFSGSNSGNTATLTISGTQAMDEADYYCQAWDSTTVVFGGGTKLTVLG

SEQ ID NO: 2053 - protein, 107 aa, Artificial Sequence
  >63AI0.3 N20R C42S VL.02
SYELTQPPSVSVSPGQTARITCSGDKLGNRYTSWYQQKSGQSPVLVIYQESERPSGIPERFSGSNSGNTATLTISGTQAMDEADYYCQAWDSTTVVFGGGTKLTVLG

SEQ ID NO: 2054 - protein, 107 aa, Artificial Sequence
  >63AI0.3 N20R C42S VL.03
SYELTQPPSVSVSPGQTARITCSGDKLGNRYTSWYQQKSGQSPVLVIYQDSERPSGIPERFSGSNSGNTATLTISGTQAMDEADYYCQAWESTTVVFGGGTKLTVLG

SEQ ID NO: 2055 - protein, 111 aa, Artificial Sequence
  >64BI0.1 VL.Ol
QSVLTQPPSVSAAPGQKVTISCSGSSSNIGNNYVAWYQQLPGTAPKLLIYDNDKRPSGIPDRFSGSKSGTSATLAITGLQTGDEADYYCGTWDSSLSAVVFGGGTKLTVLG

SEQ ID NO: 2056 - protein, 111 aa, Artificial Sequence
  >64BI0.1 VL.02
QSVLTQPPSVSAAPGQKVTISCSGSSSNIGNNYVAWYQQLPGTAPKLLIYDNDKRPSGIPDRFSGSKSGTSATLGITGLQTEDEADYYCGTWDSSLSAVVFGGGTKLTVLG

SEQ ID NO: 2057 - protein, 111 aa, Artificial Sequence
  >64BI0.1 VL.03
QSVLTQPPSVSAAPGQKVTISCSGSSSNIGNNYVAWYQQLPGTAPKLLIYDNDKRPSGIPDRFSGSKSGTSATLGITGLQTGDEADYYCGTWESSLSAVVFGGGTKLTVLG

SEQ ID NO: 2058 - protein, 123 aa, Artificial Sequence
  >64BI0.1 VH.04
QIQLQESGPGLVKPSETLSLTCTVSGGSVSSGDYYWSWIRQPPGKGLEWIGFIYYSGGTNYNPSLKSRVTISIDTSKNQFSLKLNSVTAADTAVYYCARYSSTWDYYYGVDVWGQGTTVTVSS

SEQ ID NO: 2059 - protein, 123 aa, Artificial Sequence
  >64BI0.1 VH.05
QIQLLESGPGLVKPSETLSLTCTVSGGSVSSGDYYWSWIRQPPGKGLEWIGFIYYSGGTNYNPSLKSRVTISIDTSKNQFSLKLNSVTAADTAVYYCARYSSTWDYYYGVDVWGQGTLVTVSS

SEQ ID NO: 2060 - protein, 123 aa, Artificial Sequence
  >64BI0.1 VH.06
QIQLLESGPGLVKPSETLSLTCTVSGGSVSSGDYYWSWIRQPPGKGLEWIGFIYYSGGTNYNPSLKSRVTISIDTSKNQFSLKLNSVTAADTAVYYCARYSSTWDYYYGVDVWGQGTMVTVSS

SEQ ID NO: 2061 - protein, 111 aa, Artificial Sequence
  >64BI0.1 VL.07
QSVLTQPPSVSAAPGQKVTISCSGSSSNIGNNYVAWYQQLPGTAPKLLIYDNDKRPSGIPDRFSGSKSGTSATLGITGLQTGDEADYYCGTYDSSLSAVVFGGGTKLTVLG

SEQ ID NO: 2062 - protein, 123 aa, Artificial Sequence
  >64BI0.1 VH.08
QIQLLESGPGLVKPSETLSLTCTVSGGSVSSGDYYWSWIRQPPGKGLEWIGFIYYSGGTNYNPSLKSRVTISIDTSKNQFSLKLNSVTAADTAVYYCARYSSTYDYYYGVDVWGQGTTVTVSS

SEQ ID NO: 2063 - protein, 108 aa, Artificial Sequence
  >66G2 VK.Ol
DIQMTQSPSSLSASVGDRVTITCRASQGIRNDLGWYQQKPGKAPKLLIYAASNLQSGVPSRFSGSGSGTKFTLTINSLQPEDFATYYCLQLNGYPLTFGGGTKVEIKR

SEQ ID NO: 2064 - protein, 108 aa, Artificial Sequence
  >66G2 VK.02
DIQMTQSPSSLSASVGDRVTITCRASQGIRNDLGWYQQKPGKAPKRLIYAASNLQSGVPSRFSGSGSGTEFTLTINSLQPEDFATYYCLQLNGYPLTFGGGTKVEIKR

SEQ ID NO: 2065 - protein, 108 aa, Artificial Sequence
  >66G2 VK.03
DIQMTQSPSSLSASVGDRVTITCRASQGIRNDLGWYQQKPGKAPKRLIYAASNLQSGVPSRFSGSGSGTDFTLTINSLQPEDFATYYCLQLNGYPLTFGGGTKVEIKR

SEQ ID NO: 2066 - protein, 108 aa, Artificial Sequence
  >66G2 VK.04
DIQMTQSPSSLSASVGDRVTITCRASQGIRNDLGWYQQKPGKAPKRLIYAASNLQSGVPSRFSGSGSGTKFTLTINSLQPEDFATYYCLQLQGYPLTFGGGTKVEIKR

SEQ ID NO: 2067 - protein, 123 aa, Artificial Sequence
  >66G2 VH.05
QVQLVESGGGVVQPGGSLRLSCAASGFTFSSYGMHWVRQAPGKGLEWVAGISYDGSNKNYADSVKGRITISRDNPKNTLYLQMNSLRAEDTAVYYCATTVTKEDYYYYGMDVWGQGTTVTVSS

SEQ ID NO: 2068 - protein, 123 aa, Artificial Sequence
  >66G2 VH.06
QVQLVESGGGVVQPGRSLRLSCAASGFTFSSYGMHWVRQAPGKGLEWVAGISYEGSNKNYADSVKGRITISRDNPKNTLYLQMNSLRAEDTAVYYCATTVTKEDYYYYGMDVWGQGTTVTVSS

SEQ ID NO: 2069 - protein, 123 aa, Artificial Sequence
  >66G2 VH.07
QVQLVESGGGVVQPGRSLRLSCAASGFTFSSYGMHWVRQAPGKGLEWVAGISYDGSNKNYAESVKGRITISRDNPKNTLYLQMNSLRAEDTAVYYCATTVTKEDYYYYGMDVWGQGTTVTVSS

SEQ ID NO: 2070 - protein, 123 aa, Artificial Sequence
  >66G2 VH.08
QVQLVESGGGVVQPGRSLRLSCAASGFTFSSYGMHWVRQAPGKGLEWVAGISYDGSNKNYADSVKGRFTISRDNPKNTLYLQMNSLRAEDTAVYYCATTVTKEDYYYYGMDVWGQGTTVTVSS

SEQ ID NO: 2071 - protein, 123 aa, Artificial Sequence
  >66G2 VH.09
QVQLVESGGGVVQPGRSLRLSCAASGFTFSSYGMHWVRQAPGKGLEWVAGISYDGSNKNYADSVKGRITISRDNPKNTLYLQMNSLRAEDTAVYYCAKTVTKEDYYYYGMDVWGQGTTVTVSS

SEQ ID NO: 2072 - protein, 123 aa, Artificial Sequence
  >66G2 VH.I0
QVQLVESGGGVVQPGRSLRLSCAASGFTFSSYGMHWVRQAPGKGLEWVAGISYDGSNKNYADSVKGRITISRDNPKNTLYLQMNSLRAEDTAVYYCARTVTKEDYYYYGMDVWGQGTTVTVSS

SEQ ID NO: 2073 - protein, 107 aa, Artificial Sequence
  >67F5 VK.Ol
ENMTQSPATLSVSPGERVTLSCRASQSVSSNLAWYQQKPGQAPRLLIYGSSNRAIGIPARFSGSGSGTEFTLTISSLQSADFAVYNCQQYEIWPWTFGQGTKVEIKR

SEQ ID NO: 2074 - protein, 107 aa, Artificial Sequence
  >67F5 VK.02
ENMTQSPATLSVSPGERVTLSCRASQSVSSNLAWYQQKPGQAPRLLIHGSSNRAIGIPARFSGSGSGTEFTLTISSLESADFAVYNCQQYEIWPWTFGQGTKVEIKR

SEQ ID NO: 2075 - protein, 107 aa, Artificial Sequence
  >67F5 VK.03
ENMTQSPATLSVSPGERVTLSCRASQSVSSNLAWYQQKPGQAPRLLIHGSSNRAIGIPARFSGSGSGTEFTLTISSLQPADFAVYNCQQYEIWPWTFGQGTKVEIKR

SEQ ID NO: 2076 - protein, 107 aa, Artificial Sequence
  >67F5 VK.04
ENMTQSPATLSVSPGERVTLSCRASQSVSSNLAWYQQKPGQAPRLLIHGSSNRAIGIPARFSGSGSGTEFTLTISSLQSEDFAVYNCQQYEIWPWTFGQGTKVEIKR

SEQ ID NO: 2077 - protein, 107 aa, Artificial Sequence
  >67F5 VK.05
ENMTQSPATLSVSPGERVTLSCRASQSVSSNLAWYQQKPGQAPRLLIHGSSNRAIGIPARFSGSGSGTEFTLTISSLQSADFAVYYCQQYEIWPWTFGQGTKVEIKR

SEQ ID NO: 2078 - protein, 119 aa, Artificial Sequence
  >67F5 VH.06
QVQLQESGPGLVKPSETLSLTCTVSGGSISSYYWSWIRQPPGKGLEWIGYIYYSGNTNYNPSLKSRVTISVDTSKNQFSLKLSSVTAADTAVYYCAREYYYGSGSYYPWGQGTLVTVSS

SEQ ID NO: 2079 - protein, 107 aa, Artificial Sequence
  >67F5 VK.07
ENMTQSPATLSVSPGERVTLSCRASQSVSSNLAWYQQKPGQAPRLLIHGSSNRAIGIPARFSGSGSGTEFTLTISSLQSADFAVYNCQQYEIYPWTFGQGTKVEIKR

SEQ ID NO: 2080 - protein, 107 aa, Artificial Sequence
  >67F5 VK.08
ENMTQSPATLSVSPGERVTLSCRASQSVSSNLAWYQQKPGQAPRLLIHGSSNRAIGIPARFSGSGSGTEFTLTISSLQSADFAVYNCQQYEIWPYTFGQGTKVEIKR

SEQ ID NO: 2081 - protein, 114 aa, Artificial Sequence
  >67CI0 VK.Ol
DIVMTQTPLSLPVTPGEPASISCRSSQSLLNSDDGNTYLDWYLQKPGQSPQLLIYTLSYRASGVPDRFSGSGSGTDFTLKISRVEAEDVGVYYCMQRIEFPITFGQGTRLEIKR

SEQ ID NO: 2082 - protein, 114 aa, Artificial Sequence
  >67CI0 VK.02
DFVMTQTPLSLPVTPGEPASISCRSSQSLLNSDEGNTYLDWYLQKPGQSPQLLIYTLSYRASGVPDRFSGSGSGTDFTLKISRVEAEDVGVYYCMQRIEFPITFGQGTRLEIKR

SEQ ID NO: 2083 - protein, 123 aa, Artificial Sequence
  >67CI0 VH.03
EVQLVQSGAEVKKPGESLKISCKGSGYSFSSYWIGWVRQMPGKGLEWMGIIYPGDSDTRYSPSFQGQVTISADKSINTAYLQWSSLKASDTAIYYCARRASRGYRYGLAFAIWGQGTMVTVSS

SEQ ID NO: 2084 - protein, 123 aa, Artificial Sequence
  >67CI0 VH.04
EVQLVQSGAEVKKPGESLKISCQGSGYSFSSYWIGWVRQMPGKGLEWMGIIYPGESDTRYSPSFQGQVTISADKSINTAYLQWSSLKASDTAIYYCARRASRGYRYGLAFAIWGQGTMVTVSS

SEQ ID NO: 2085 - protein, 111 aa, Artificial Sequence
  >68C8 VL.Ol
QSVLTQPPSVSAAPGQKVTISCSGSSSNIGNNYVSWYQQLPGTAPKLLIYDNNKRPSGIPDRFSGSKSGTSATLAITGLQTGDEADYYCGTWDSSLSAVVFGGGTKLTVLG

SEQ ID NO: 2086 - protein, 111 aa, Artificial Sequence
  >68C8 VL.02
QSVLTQPPSVSAAPGQKVTISCSGSSSNIGNNYVSWYQQLPGTAPKLLIYDNNKRPSGIPDRFSGSKSGTSATLGITGLQTEDEADYYCGTWDSSLSAVVFGGGTKLTVLG

SEQ ID NO: 2087 - protein, 111 aa, Artificial Sequence
  >68C8 VL.03
QSVLTQPPSVSAAPGQKVTISCSGSSSNIGNNYVSWYQQLPGTAPKLLIYDNNKRPSGIPDRFSGSKSGTSATLGITGLQTGDEADYYCGTWESSLSAVVFGGGTKLTVLG

SEQ ID NO: 2088 - protein, 123 aa, Artificial Sequence
  >68C8 VH.04
QVQLQESGPGLVKPSETLSLTCTVSGGSVSSGDNYWSWIRQPPGKGLEWIGFMFYSGSTNYNPSLKSRVTISLHTSKNQFSLRLSSVTAADTAVYYCGRYRSDWDYYYGMDVWGQGTTVTVSS

SEQ ID NO: 2089 - protein, 123 aa, Artificial Sequence
  >68C8 VH.05
QVQLQESGPGLVKPSETLSLTCTVSGDSVSSGDNYWSWIRQPPGKGLEWIGFMFYSGSTNYNPSLKSRVTISLDTSKNQFSLRLSSVTAADTAVYYCGRYRSDWDYYYGMDVWGQGTTVTVSS

SEQ ID NO: 2090 - protein, 123 aa, Artificial Sequence
  >68C8 VH.06
QVQLQESGPGLVKPSETLSLTCTVSGDSVSSGDNYWSWIRQPPGKGLEWIGFMFYSGSTNYNPSLKSRVTISLHTSKNQFSLRLSSVTAADTAVYYCARYRSDWDYYYGMDVWGQGTTVTVSS

SEQ ID NO: 2091 - protein, 123 aa, Artificial Sequence
  >68C8 VH.07
QVQLQESGPGLVKPSETLSLTCTVSGDSVSSGDNYWSWIRQPPGKGLEWIGFMFYSGSTNYNPSLKSRVTISLHTSKNQFSLRLSSVTAADTAVYYCGRYRSDWDYYYGMDVWGQGTLVTVSS

SEQ ID NO: 2092 - protein, 123 aa, Artificial Sequence
  >68C8 VH.08
QVQLQESGPGLVKPSETLSLTCTVSGDSVSSGDNYWSWIRQPPGKGLEWIGFMFYSGSTNYNPSLKSRVTISLHTSKNQFSLRLSSVTAADTAVYYCGRYRSDWDYYYGMDVWGQGTMVTVSS

SEQ ID NO: 2093 - protein, 111 aa, Artificial Sequence
  >68C8 VL.09
QSVLTQPPSVSAAPGQKVTISCSGSSSNIGNNYVSWYQQLPGTAPKLLIYDNNKRPSGIPDRFSGSKSGTSATLGITGLQTGDEADYYCGTYDSSLSAVVFGGGTKLTVLG

SEQ ID NO: 2094 - protein, 123 aa, Artificial Sequence
  >68C8 VH.lO
QVQLQESGPGLVKPSETLSLTCTVSGDSVSSGDNYWSWIRQPPGKGLEWIGFMFYSGSTNYNPSLKSRVTISLHTSKNQFSLRLSSVTAADTAVYYCGRYRSDYDYYYGMDVWGQGTTVTVSS

What is claimed is:

1. An isolated antigen binding protein that induces FGF21-mediated signaling, wherein the antigen binding protein comprises a light chain CDR1 comprising the sequence of SEQ ID NO: 821, a light chain CDR2 comprising the sequence of SEQ ID NO: 900, a light chain CDR3 comprising the sequence of SEQ ID NO: 954, a heavy chain CDR1 comprising the sequence of SEQ ID NO: 611, a heavy chain CDR2 comprising the sequence of SEQ ID NO: 664, and a heavy chain CDR3 comprising the sequence of SEQ ID NO: 741.

2. The antigen binding protein of claim 1, comprising one or more of:
   (a) a light chain variable domain sequence comprising $V_L 47$ of Table 2A (SEQ ID NO. 263);
   (b) a heavy chain variable domain sequence comprising $V_H 46$ of Table 2B (SEQ ID NO: 361); or
   (c) a combination comprising a light chain variable domain of (a) and a heavy chain variable domain of (b).

3. The antigen binding protein of claim 2, wherein the light chain variable domain and the heavy chain variable domain comprise $V_L 47$ and $V_H 46$.

4. The antigen binding protein of claim 3, further comprising:
   (a) the kappa light chain constant sequence of SEQ ID NO: 12
   (b) the lambda light chain constant sequence of SEQ ID NO: 13
   (c) the heavy chain constant sequence of SEQ ID NO: 11; or
   (d) (i) the kappa light chain constant sequence of SEQ ID NO: 12 or
        the lambda light chain constant sequence of SEQ ID NO: 13, and
       (ii) the heavy chain constant sequence of SEQ ID NO: 11.

5. The antigen binding protein of claim 1, wherein the antigen binding protein is a human antibody, a humanized antibody, chimeric antibody, a monoclonal antibody, a polyclonal antibody, a recombinant antibody, an antigen-binding antibody fragment, a single chain antibody, a diabody, a triabody, a tetrabody, a Fab fragment, an F(fab')₂ fragment, an IgD antibody, an IgE antibody, an IgM antibody, an IgG1 antibody, an IgG2 antibody, an IgG3 antibody, an IgG4 antibody, or an IgG4 antibody having at least one mutation in the hinge region.

6. A pharmaceutical composition comprising one or more antigen binding proteins of claim 1, 2, 3, 4 or 5 in admixture with a pharmaceutically acceptable carrier thereof.

7. The antigen binding protein of claim 1, wherein the antigen binding protein comprises one or more non-naturally occurring or encoded amino acids.

8. A method of treating a condition in a subject in need of such treatment comprising administering a therapeutically effective amount of the composition of claim 6 to the subject, wherein the condition is treatable by lowering one or more of blood glucose, insulin or serum lipid levels.

9. The method of claim 8, wherein the condition is type 2 diabetes, obesity, dyslipidemia, NASH, cardiovascular disease or metabolic syndrome.

10. An isolated nucleic acid comprising a polynucleotide sequence encoding the light chain variable domain amino acid sequence, the heavy chain variable domain amino acid sequence, or both amino add sequences, of an antigen binding protein that induces FGF21-mediated signaling, wherein the antigen binding protein comprises a light chain CDR1 comprising the sequence of SEQ ID NO: 821, a light chain CDR2 comprising the sequence of SEQ ID NO: 900, a light chain CDR3 comprising the sequence of SEQ ID NO: 954, a heavy chain CDR1 comprising the sequence of SEQ ID NO: 611, a heavy chain CDR2 comprising the sequence of SEQ ID NO: 664, and a heavy chain CDR3 comprising the sequence of SEQ ID NO: 741.

11. An expression vector comprising the nucleic acid of claim 10.

12. An isolated cell comprising the nucleic acid of claim 11.

13. An isolated cell comprising the expression vector of claim 12.

14. A method of producing an antigen binding protein comprising incubating the host cell of claim 13 under conditions that allow it to express the antigen binding protein.

* * * * *

UNITED STATES PATENT AND TRADEMARK OFFICE
CERTIFICATE OF CORRECTION

PATENT NO.        : 9,574,002 B2                                          Page 1 of 1
APPLICATION NO.   : 13/487061
DATED             : February 21, 2017
INVENTOR(S)       : Li et al.

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 195 days.

Signed and Sealed this

Twenty-fifth Day of September, 2018

Andrei Iancu
*Director of the United States Patent and Trademark Office*